United States Patent
Bryson

(10) Patent No.: US 12,529,041 B2
(45) Date of Patent: Jan. 20, 2026

(54) COMPOSITIONS AND METHODS FOR DELIVERING A NUCLEOBASE EDITING SYSTEM

(71) Applicant: Beam Therapeutics Inc., Cambridge, MA (US)

(72) Inventor: David Bryson, Cambridge, MA (US)

(73) Assignee: Beam Therapeutics Inc., Cambridge, MA (US)

( * ) Notice: Subject to any disclaimer, the term of this patent is extended or adjusted under 35 U.S.C. 154(b) by 997 days.

(21) Appl. No.: 17/273,209

(22) PCT Filed: Sep. 7, 2019

(86) PCT No.: PCT/US2019/050111
§ 371 (c)(1),
(2) Date: Mar. 3, 2021

(87) PCT Pub. No.: WO2020/051561
PCT Pub. Date: Mar. 12, 2020

(65) Prior Publication Data
US 2021/0301274 A1    Sep. 30, 2021

Related U.S. Application Data

(60) Provisional application No. 62/779,404, filed on Dec. 13, 2018, provisional application No. 62/728,703, filed on Sep. 7, 2018.

(51) Int. Cl.
| C12N 9/22 | (2006.01) |
| C12N 9/78 | (2006.01) |
| C12N 15/11 | (2006.01) |
| C12N 15/90 | (2006.01) |

(52) U.S. Cl.
CPC ............. *C12N 9/22* (2013.01); *C12N 9/78* (2013.01); *C12N 15/11* (2013.01); *C12N 15/907* (2013.01); *C12Y 305/04004* (2013.01); *C07K 2319/09* (2013.01); *C12N 2310/20* (2017.05); *C12N 2800/80* (2013.01)

(58) Field of Classification Search
CPC ...... C12N 9/22; C12N 15/11; C12N 2310/20; C12Y 305/04004; C07K 2319/09
See application file for complete search history.

(56) References Cited

U.S. PATENT DOCUMENTS

| 7,915,114 B2 | 3/2011 | Hsiao et al. |
| 9,068,179 B1 | 6/2015 | Liu et al. |
| 9,322,037 B2 | 4/2016 | Liu et al. |
| 9,388,430 B2 | 7/2016 | Liu et al. |
| 9,512,446 B1 | 12/2016 | Joung et al. |
| 9,737,604 B2 | 8/2017 | Liu et al. |
| 9,840,699 B2 | 12/2017 | Liu et al. |
| 10,113,163 B2 | 10/2018 | Liu et al. |
| 10,167,457 B2 | 1/2019 | Liu et al. |
| 10,465,176 B2 | 11/2019 | Liu et al. |
| 10,526,401 B2 | 1/2020 | Muir et al. |
| 10,682,410 B2 | 6/2020 | Liu et al. |
| 10,745,677 B2 | 8/2020 | Maianti et al. |
| 10,912,833 B2 | 2/2021 | Liu et al. |
| 10,947,530 B2 | 3/2021 | Liu et al. |
| 11,053,481 B2 | 7/2021 | Liu et al. |
| 11,124,782 B2 | 9/2021 | Liu et al. |
| 11,142,550 B2 | 10/2021 | Muir et al. |
| 11,142,760 B2 | 10/2021 | Slaymaker et al. |
| 11,155,803 B2 | 10/2021 | Gaudelli et al. |
| 11,161,899 B2 | 11/2021 | Muir et al. |
| 11,193,123 B2 | 12/2021 | Halperin |
| 11,214,780 B2 | 1/2022 | Liu et al. |
| 11,268,082 B2 | 3/2022 | Liu et al. |
| 11,306,324 B2 | 4/2022 | Liu et al. |
| 11,319,532 B2 | 5/2022 | Liu et al. |
| 11,479,767 B2 | 10/2022 | Smith et al. |

(Continued)

FOREIGN PATENT DOCUMENTS

| CA | 2877882 A1 | 1/2014 |
| CA | 3051195 A1 | 8/2017 |

(Continued)

OTHER PUBLICATIONS

Cheriyan, et al., "Traceless splicing enabled by substrate-induced activation of the Nostoc punctiforme Npu DnaE intein after mutation of a catalytic cysteine to serine", Journal of Molecular Biology, vol. 426, No. 24, pp. 4018-4029, Dec. 12, 2014.

International Search Report and Written Opinion in corresponding International Patent Application No. PCT/US19/50111, mailed Feb. 11, 2020 (18 pages).

Lau et al., "Molecular basis for discriminating between normal and damaged bases by the human alkyladenine glycosylase, AAG," Proceedings of the National Academy of Sciences of the United States of America, Dec. 5, 2000, vol. 97, No. 25, pp. 13573-13578.

Lazar et al., "Transforming Growth Factor α: Mutation of Aspartic Acid 47 and Leucine 48 Results in Different Biological Activities," Molecular and Cellular Biology, Mar. 1988, vol. 8, No. 3, pp. 1247-1252.

(Continued)

*Primary Examiner* — Tracy Vivlemore
*Assistant Examiner* — Allison Marie Johnson
(74) *Attorney, Agent, or Firm* — Greenberg Traurig, LLP; Melissa Hunter-Ensor; Nicholas R. Ballor

(57) ABSTRACT

The invention provides compositions and methods for delivering first and second polynucleotides each encoding a fragment of an A-to-G Base Editor fusion protein comprising one or more deaminases (e.g., adenosine deaminases) and nCas9, wherein the first polynucleotide encodes an N-terminal fragment of nCas9 fused to an intein-N of a split intein pair and the second polynucleotide encodes a C-terminal fragment of nCas9 fused to an intein-C of a split intein pair, and methods for delivering these fragments together with an sgRNA to a cell (e.g., AAV delivery), where the fragments are spliced together by a split intein system, thereby reconstituting a functional base editing system in the cell.

19 Claims, 7 Drawing Sheets
Specification includes a Sequence Listing.

(56) References Cited

U.S. PATENT DOCUMENTS

| | | |
|---|---|---|
| 11,530,245 B2 | 12/2022 | Zhang et al. |
| 11,542,496 B2 | 1/2023 | Liu et al. |
| 11,667,676 B2 | 6/2023 | Chong et al. |
| 11,667,682 B2 | 6/2023 | Zhang et al. |
| 11,702,651 B2 | 7/2023 | Liu et al. |
| 11,732,274 B2 | 8/2023 | Liu et al. |
| 12,129,478 B1 | 10/2024 | Chen et al. |
| 12,241,096 B2 | 3/2025 | Joung et al. |
| 2004/0003420 A1 | 1/2004 | Kuhn et al. |
| 2004/0115184 A1 | 6/2004 | Smith et al. |
| 2005/0222030 A1 | 10/2005 | Allison |
| 2011/0104787 A1 | 5/2011 | Church et al. |
| 2013/0109048 A1 | 5/2013 | Giugliano et al. |
| 2014/0068797 A1 | 3/2014 | Doudna et al. |
| 2014/0186958 A1 | 7/2014 | Zhang et al. |
| 2014/0273226 A1 | 9/2014 | Wu |
| 2014/0273230 A1 | 9/2014 | Chen et al. |
| 2014/0356956 A1 | 12/2014 | Church et al. |
| 2015/0071903 A1 | 3/2015 | Liu et al. |
| 2015/0165054 A1 | 6/2015 | Liu et al. |
| 2015/0166980 A1 | 6/2015 | Liu et al. |
| 2015/0166982 A1 | 6/2015 | Liu et al. |
| 2015/0166984 A1 | 6/2015 | Liu et al. |
| 2015/0166985 A1 | 6/2015 | Liu et al. |
| 2015/0344549 A1 | 12/2015 | Muir et al. |
| 2016/0046961 A1 | 2/2016 | Jinek et al. |
| 2016/0200779 A1 | 7/2016 | Liu et al. |
| 2016/0201089 A1 | 7/2016 | Gersbach et al. |
| 2016/0208243 A1 | 7/2016 | Zhang et al. |
| 2016/0304846 A1 | 10/2016 | Liu et al. |
| 2017/0121693 A1 | 5/2017 | Liu et al. |
| 2017/0233703 A1* | 8/2017 | Xie .................. C12N 15/90 514/44 R |
| 2017/0268022 A1* | 9/2017 | Liu .................. C12P 19/34 |
| 2017/0275648 A1 | 9/2017 | Barrangou et al. |
| 2017/0327804 A9 | 11/2017 | Joung et al. |
| 2018/0073012 A1 | 3/2018 | Liu et al. |
| 2018/0127780 A1* | 5/2018 | Liu .................. A61P 21/00 |
| 2018/0155708 A1 | 6/2018 | Church et al. |
| 2018/0179503 A1 | 6/2018 | Maianti et al. |
| 2018/0216095 A1 | 8/2018 | Thanos et al. |
| 2018/0237787 A1 | 8/2018 | Maianti et al. |
| 2018/0312828 A1 | 11/2018 | Liu et al. |
| 2019/0002875 A1 | 1/2019 | Cheng et al. |
| 2019/0010481 A1 | 1/2019 | Joung et al. |
| 2019/0093099 A1 | 3/2019 | Liu et al. |
| 2019/0225955 A1 | 7/2019 | Liu et al. |
| 2019/0367891 A1 | 12/2019 | Liu et al. |
| 2020/0063127 A1 | 2/2020 | Lu et al. |
| 2020/0190493 A1 | 6/2020 | Liu et al. |
| 2020/0308571 A1 | 10/2020 | Joung et al. |
| 2021/0252118 A1 | 8/2021 | Slaymaker et al. |
| 2021/0317440 A1 | 10/2021 | Liu et al. |
| 2021/0371467 A1 | 12/2021 | Muir et al. |
| 2021/0371858 A1 | 12/2021 | Evans et al. |
| 2021/0371878 A1 | 12/2021 | Auricchio et al. |
| 2021/0380955 A1 | 12/2021 | Bryson et al. |
| 2022/0047637 A1 | 2/2022 | Lamothe-Dreuzy et al. |
| 2022/0098293 A1 | 3/2022 | Muir et al. |
| 2022/0119785 A1 | 4/2022 | Liu et al. |
| 2022/0127594 A1 | 4/2022 | Gaudelli et al. |
| 2022/0136012 A1 | 5/2022 | Gaudelli et al. |
| 2022/0169998 A1 | 6/2022 | Joung et al. |
| 2022/0170027 A1 | 6/2022 | Gaudelli et al. |
| 2022/0213507 A1 | 7/2022 | Liu et al. |
| 2022/0220462 A1 | 7/2022 | Liu et al. |
| 2022/0290115 A1 | 9/2022 | Liu et al. |
| 2022/0290134 A1 | 9/2022 | Jin et al. |
| 2022/0290164 A1 | 9/2022 | Ran et al. |
| 2022/0307003 A1 | 9/2022 | Liu |
| 2022/0387622 A1 | 12/2022 | Gehrke et al. |
| 2023/0075877 A1 | 3/2023 | Gaudelli et al. |
| 2023/0101597 A1 | 3/2023 | Gaudelli et al. |
| 2023/0140953 A1 | 5/2023 | Slaymaker et al. |
| 2023/0159956 A1 | 5/2023 | Bryson et al. |
| 2023/0212575 A1 | 7/2023 | Odate et al. |
| 2023/0383277 A1 | 11/2023 | Cafferty et al. |
| 2023/0407277 A1 | 12/2023 | Joung et al. |
| 2024/0132867 A1 | 4/2024 | Gaudelli et al. |

FOREIGN PATENT DOCUMENTS

| | | |
|---|---|---|
| CA | 3039928 A1 | 4/2018 |
| CA | 3116606 A1 | 4/2020 |
| CA | 3143327 A1 | 12/2020 |
| CA | 3147875 A1 | 1/2021 |
| CN | 103088008 A | 5/2013 |
| CN | 105934516 A | 9/2016 |
| CN | 106061510 A | 10/2016 |
| CN | 106459957 A | 2/2017 |
| CN | 106916852 A | 7/2017 |
| CN | 107043779 A | 8/2017 |
| CN | 107109413 A | 8/2017 |
| CN | 108064282 A | 5/2018 |
| CN | 108884154 A | 11/2018 |
| CN | 109295186 A | 2/2019 |
| CN | 109957569 A | 7/2019 |
| CN | 110214180 A | 9/2019 |
| CN | 112969790 A | 6/2021 |
| CN | 113348249 A | 9/2021 |
| CN | 113735941 A | 12/2021 |
| CN | 113813398 A | 12/2021 |
| CN | 113480613 B | 4/2022 |
| CN | 114667149 A | 6/2022 |
| EP | 2877490 B1 | 9/2018 |
| EP | 3885440 A1 | 9/2021 |
| EP | 4019537 A1 | 6/2022 |
| EP | 3431497 B1 | 7/2022 |
| EP | 3408292 B1 | 4/2023 |
| JP | 2015522020 A | 8/2015 |
| JP | 2017500035 A | 1/2017 |
| JP | 2018111685 A | 7/2018 |
| JP | 2019506163 A | 3/2019 |
| JP | 2019530464 A | 10/2019 |
| JP | 6629734 A2 | 1/2020 |
| JP | 2020523006 A | 8/2020 |
| JP | 2021532794 A | 12/2021 |
| JP | 2022500017 A | 1/2022 |
| JP | 2022512718 A | 2/2022 |
| JP | 2022519761 A | 3/2022 |
| JP | 2022519882 A | 3/2022 |
| JP | 2022520080 A | 3/2022 |
| JP | 2022520081 A | 3/2022 |
| JP | 2022520231 A | 3/2022 |
| JP | 2022520233 A | 3/2022 |
| JP | 2022521460 A | 4/2022 |
| JP | 2022532139 A | 7/2022 |
| KR | 20160050069 A | 5/2016 |
| KR | 102129377 B1 | 7/2020 |
| WO | 2001038547 A2 | 5/2001 |
| WO | 2002068676 A2 | 9/2002 |
| WO | 2002103028 A2 | 12/2002 |
| WO | 2010132092 A2 | 11/2010 |
| WO | 2011075627 A1 | 6/2011 |
| WO | 2013045632 A1 | 4/2013 |
| WO | 2013176772 A1 | 11/2013 |
| WO | 2013188037 A2 | 12/2013 |
| WO | 2014004336 A2 | 1/2014 |
| WO | 2014089290 A1 | 6/2014 |
| WO | 2014184143 A1 | 11/2014 |
| WO | 2014184741 A1 | 11/2014 |
| WO | 2014186686 A2 | 11/2014 |
| WO | 2015006498 A2 | 1/2015 |
| WO | 2015021426 A1 | 2/2015 |
| WO | 2015089277 A1 | 6/2015 |
| WO | 2015089406 A1 | 6/2015 |
| WO | 2015090230 A1 | 6/2015 |
| WO | 2015092024 A2 | 6/2015 |
| WO | 2015142675 A2 | 9/2015 |
| WO | 2015191693 A2 | 12/2015 |
| WO | 2016011210 A2 | 1/2016 |
| WO | 2016016343 A1 | 2/2016 |
| WO | 2016061368 A1 | 4/2016 |
| WO | 2016069910 A1 | 5/2016 |

(56) References Cited

FOREIGN PATENT DOCUMENTS

| | | |
|---|---|---|
| WO | 2016072399 A1 | 5/2016 |
| WO | 2016073649 A1 | 5/2016 |
| WO | 2016075612 A1 | 5/2016 |
| WO | 2016094304 A2 | 6/2016 |
| WO | 2016138038 A1 | 9/2016 |
| WO | 2016142532 A2 | 9/2016 |
| WO | 2016196388 A1 | 12/2016 |
| WO | 2016205711 A1 | 12/2016 |
| WO | 2016205759 A1 | 12/2016 |
| WO | 2017011721 A1 | 1/2017 |
| WO | 2017048969 A1 | 3/2017 |
| WO | 2017049166 A1 | 3/2017 |
| WO | 2017070632 A2 | 4/2017 |
| WO | 2017070633 A2 | 4/2017 |
| WO | 2017077386 A1 | 5/2017 |
| WO | 2017079703 A1 | 5/2017 |
| WO | 2017079705 A1 | 5/2017 |
| WO | 2017093804 A2 | 6/2017 |
| WO | 2017132580 A2 | 8/2017 |
| WO | 2017165862 A1 | 9/2017 |
| WO | 2017173054 A1 | 10/2017 |
| WO | 2017180993 A1 | 10/2017 |
| WO | 2017184768 A1 | 10/2017 |
| WO | 2017189308 A1 | 11/2017 |
| WO | 2018020323 A2 | 2/2018 |
| WO | 2018027036 A1 | 2/2018 |
| WO | 2018027078 A1 | 2/2018 |
| WO | 2018035388 A1 | 2/2018 |
| WO | 2018035503 A1 | 2/2018 |
| WO | 2018041973 A1 | 3/2018 |
| WO | 2018071868 A1 | 4/2018 |
| WO | 2018085690 A1 | 5/2018 |
| WO | 2018089664 A1 | 5/2018 |
| WO | 2018129129 A1 | 7/2018 |
| WO | 2018160768 A1 | 9/2018 |
| WO | 2018165629 A1 | 9/2018 |
| WO | 2018176009 A1 | 9/2018 |
| WO | 2018213708 A1 | 11/2018 |
| WO | 2018213726 A1 | 11/2018 |
| WO | 2018218188 A2 | 11/2018 |
| WO | 2018226602 A1 | 12/2018 |
| WO | 2019005884 A1 | 1/2019 |
| WO | 2019005886 A1 | 1/2019 |
| WO | 2019023680 A1 | 1/2019 |
| WO | 2019040650 A1 | 2/2019 |
| WO | 2019071274 A1 | 4/2019 |
| WO | 2019079347 A1 | 4/2019 |
| WO | 2019120310 A1 | 6/2019 |
| WO | 2019139645 A2 | 7/2019 |
| WO | 2019183000 A1 | 9/2019 |
| WO | 2019217941 A1 | 11/2019 |
| WO | 2019217942 A1 | 11/2019 |
| WO | 2019217943 A1 | 11/2019 |
| WO | 2019217944 A1 | 11/2019 |
| WO | 2019226953 A1 | 11/2019 |
| WO | 2020028823 A1 | 2/2020 |
| WO | 2020041751 A1 | 2/2020 |
| WO | 2020051561 A1 | 3/2020 |
| WO | 2020079034 A2 | 4/2020 |
| WO | 2020112870 A1 | 6/2020 |
| WO | 2020146627 A1 | 7/2020 |
| WO | 2020160514 A1 | 8/2020 |
| WO | 2020160517 A1 | 8/2020 |
| WO | 2020163596 A1 | 8/2020 |
| WO | 2020168051 A1 | 8/2020 |
| WO | 2020168075 A1 | 8/2020 |
| WO | 2020168088 A1 | 8/2020 |
| WO | 2020168122 A1 | 8/2020 |
| WO | 2020168132 A1 | 8/2020 |
| WO | 2020168133 A1 | 8/2020 |
| WO | 2020168135 A1 | 8/2020 |
| WO | 2020214842 A1 | 10/2020 |
| WO | 2020231863 A1 | 11/2020 |
| WO | 2020236936 A1 | 11/2020 |
| WO | 2020236982 A1 | 11/2020 |
| WO | 2020252455 A1 | 12/2020 |
| WO | 2021016075 A1 | 1/2021 |
| WO | 2021020884 A2 | 2/2021 |
| WO | 2021022043 A2 | 2/2021 |
| WO | 2021041885 A2 | 3/2021 |
| WO | 2021042062 A2 | 3/2021 |
| WO | 2021050571 A1 | 3/2021 |
| WO | 2021055459 A1 | 3/2021 |
| WO | 2021062227 A2 | 4/2021 |
| WO | 2021081264 A1 | 4/2021 |
| WO | 2021087182 A1 | 5/2021 |
| WO | 2021102390 A1 | 5/2021 |
| WO | 2021108717 A2 | 6/2021 |
| WO | 2021123789 A1 | 6/2021 |
| WO | 2021158921 A2 | 8/2021 |
| WO | 2021178709 A1 | 9/2021 |
| WO | 2021178717 A2 | 9/2021 |
| WO | 2021178720 A2 | 9/2021 |
| WO | 2021191447 A1 | 9/2021 |
| WO | 2021207651 A2 | 10/2021 |
| WO | 2021209574 A1 | 10/2021 |
| WO | 2021178898 A9 | 11/2021 |
| WO | 2021222318 A1 | 11/2021 |
| WO | 2022008935 A1 | 1/2022 |
| WO | 2022015969 A1 | 1/2022 |
| WO | 2022020800 A2 | 1/2022 |
| WO | 2022056254 A2 | 3/2022 |
| WO | 2022056324 A1 | 3/2022 |
| WO | 2022081890 A1 | 4/2022 |
| WO | 2022112404 A1 | 6/2022 |
| WO | 2022148955 A1 | 7/2022 |
| WO | 2022150367 A1 | 7/2022 |
| WO | 2022150372 A1 | 7/2022 |
| WO | 2022150706 A2 | 7/2022 |
| WO | 2022204574 A1 | 9/2022 |
| WO | 2023279118 A2 | 1/2023 |
| WO | 2023288304 A2 | 1/2023 |
| WO | 2023034959 A2 | 3/2023 |
| WO | 2023047338 A2 | 3/2023 |
| WO | 2023049299 A2 | 3/2023 |
| WO | 2023125814 A1 | 7/2023 |
| WO | 2023155901 A1 | 8/2023 |
| WO | 2023193536 A1 | 10/2023 |
| WO | 2023227669 A2 | 11/2023 |
| WO | 2023247753 A1 | 12/2023 |
| WO | 2023248110 A1 | 12/2023 |
| WO | 2024040083 A1 | 2/2024 |
| WO | 2024063273 A1 | 3/2024 |
| WO | 2024073385 A2 | 6/2024 |
| WO | 2024179426 A2 | 9/2024 |
| WO | 2024226156 A1 | 10/2024 |
| WO | 2024227047 A2 | 10/2024 |
| WO | 2024259364 A2 | 12/2024 |

OTHER PUBLICATIONS

Lee et al., "PIK3CA gene is frequently mutated in breast carcinomas and hepatocellular carcinomas," Oncogene, 2005, vol. 24, pp. 1477-1480.
Lenk et al., "Pathogenic Mechanism of the FIG4 Mutation Responsible for Charcot-Marie-Tooth Disease CMT4J," PLoS Genetics, Jun. 2011, vol. 7, No. 6, e1002104, pp. 1-13.
Li et al., "Current Approaches for Engineering Proteins with Diverse Biological Properties," Bio-Applications of Nanoparticles, 2007, pp. 1-16.
Liu et al., "C2c1-sgRNA Complex Structure Reveals RNA-Guided DNA Cleavage Mechanism," Molecular Cell, Jan. 19, 2017, vol. 65, pp. 310-322.
Lyons et al., "Efficient Recognition of an Unpaired Lesion by a DNA Repair Glycosylase," Journal of the American Chemical Society, 2009, vol. 131, No. 49, pp. 17742-17743.
Makarova et al., "Classification and Nomenclature of CRISPR-Cas Systems: Where from Here?," The CRISPR Journal, 2018, vol. 1, No. 5, pp. 325-336.
Mali et al., "Cas9 as a versatile tool for engineering biology," Nature Methods, Oct. 2013, vol. 10, No. 10, pp. 957-963.

(56) References Cited

OTHER PUBLICATIONS

Mali et al., "CAS9 transcriptional activators for target specificity screening and paired nickases for cooperative genome engineering," Nature Biotechnology, 2013, pp. 1-6.
Mccann et al., "MagnEdit—interacting factors that recruit DNA-editing enzymes to single base targets," Life Science Alliance, 2020, vol. 3, No. 4, e201900606, pp. 1-9.
Mikami et al., "Comparison of CRISPR/Cas9 expression constructs for efficient targeted mutagenesis in rice," Plant Molecular Biology, 2015, vol. 88, pp. 561-572.
Miller et al., "Continuous evolution of SpCas9 variants compatible with non-G PAMs," Nature Biotechnology, Apr. 2020, vol. 38, No. 4, pp. 471-481.
Mohamad et al., "Human hemoglobin G-Makassar variant masquerading as sickle cell anemia," Hematology Reports, 2018, vol. 10, No. 7210, pp. 92-95.
Mullins et al., "Transgenesis in Nonmurine Species," Hypertension, Oct. 1993, vol. 22, No. 4, pp. 630-633.
Navaratnam et al., "An Overview of Cytidine Deaminases," International Journal of Hematology, 2006, vol. 83, pp. 195-200.
Nishida et al., "Targeted nucleotide editing using hybrid prokaryotic and vertebrate adaptive immune systems," Science, Sep. 16, 2016, vol. 353, No. 6305, pp. 1248-aaf8729-8.
Nishimasu et al., "Engineered CRISPR-Cas9 nuclease with expanded targeting space," Science, Sep. 21, 2018, vol. 361, pp. 1259-1262.
Parr et al., "N1-Methylpseudouridine substitution enhances the performance of synthetic mRNA switches in cells," Nucleic Acids Research, 2020, vol. 48, No. 6, e35, pp. 1-9.
Pausch et al., "CRISPR-CasΦ from huge phages is a hypercompact genome editor," Science, Jul. 17, 2020, vol. 369, No. 6501, pp. 333-337.
Phillips, Anthony J., "The challenge of gene therapy and DNA delivery," Journal of Pharmacy and Pharmacology, 2001, vol. 53, pp. 1169-1174.
Poller et al., "A Leucine-to-Proline Substitution Causes a Defective α1-Antichymotrypsin Allele Associated with Familial Obstructive Lung Disease," Genomics, 1993, vol. 17, pp. 740-743.
Qi et al., "Repurposing CRISPR as an RNA-Guided Platform for Sequence-Specific Control of Gene Expression," Cell, Feb. 28, 2013, vol. 152, pp. 1173-1183.
Rees et al., "Analysis and minimization of cellular RNA editing by DNA adenine base editors," Science Advances, May 8, 2019, vol. 5, No. eaax5717, pp. 1-10.
Rees et al., "Base editing: precision chemistry on the genome and transcriptome of living cells," Nature Reviews Genetics, Dec. 2018, vol. 19, No. 12, pp. 770-788.
Richter et al., "Phage-assisted evolution of an adenine base editor with improved Cas domain compatibility and activity," Nature Biotechnology, Jul. 2020, vol. 38, No. 7, pp. 883-891.
Sang, Helen, "Prospects for transgenesis in the chick," Mechanisms of Development, 2004, vol. 121, pp. 1179-1186.
Shmakov et al., "Discovery and Functional Characterization of Diverse Class 2 CRISPR-Cas Systems," Molecular Cell, Nov. 5, 2015, vol. 60, pp. 385-397.
Slaymaker et al., "Rationally engineered Cas9 nucleases with improved specificity," Science, Jan. 1, 2016, vol. 351, No. 6268, pp. 84-88.
Tan et al., "Engineering of high-precision base editors for site-specific single nucleotide replacement," Nature Communications, 2019, vol. 10, No. 439, pp. 1-10.
Tanenbaum et al., "A Protein-Tagging System for Signal Amplification in Gene Expression and Fluorescence Imaging," Cell, Oct. 23, 2014, vol. 159, pp. 635-646.
UniProt Accession No. P01011, Create Date Jul. 21, 1986.
UniProt Accession No. Q99ZW2, Create Date Jul. 11, 2012.
Wacey et al., "Disentangling the perturbational effects of amino acid substitutions in the DNA-binding domain of p53," Human Genetics, 1999, vol. 104, pp. 15-22.
Walton et al., "Unconstrained genome targeting with near-PAMless engineered CRISPR-Cas9 variants," Science, Mar. 26, 2020, pp. 1-11.
Wang et al., "Eliminating base-editor-induced genome-wide and transcriptome-wide off-target mutations," Nature Cell Biology, 2021, pp. 1-32.
Wolf et al., "tadA, an essential tRNA-specific adenosine deaminase from *Escherichia coli*," The EMBO Journal, 2002, vol. 21, No. 14, pp. 3841-3851.
Yan et al., "Functionally diverse type V CRISPR-Cas systems," Science, Jan. 4, 2019, vol. 363, pp. 88-91.
Yang et al., "Engineering and optimising deaminase fusions for genome editing," Nature Communications, 2016, vol. 7, No. 13330, pp. 1-11.
Yang et al., "PAM-Dependent Target DNA Recognition and Cleavage by C2c1 CRISPR-Cas Endonuclease," Cell, Dec. 15, 2016, vol. 167, pp. 1814-1828.
Yu et al., "Cytosine base editors with minimized unguided DNA and RNA off-target events and high on-target activity," Nature Communications, 2020, vol. 11, No. 2052, pp. 1-10.
Zafra et al., "Optimized base editors enable efficient editing in cells, organoids and mice," Nature Biotechnology, 2018, pp. 1-6.
Zheng et al., "DNA Editing in DNA/RNA Hybrids by Adenosine Deaminases That Act on RNA," Nucleic Acids Research, 2017, vol. 45, No. 6, pp. 3369-3377.
Zhou et al., "Atypical behaviour and connectivity in SHANK3-mutant macaques," Nature, Jun. 20, 2019, vol. 570, pp. 326-331.
Zuris et al., "Efficient Delivery of Genome-Editing Proteins in Vitro and in Vivo," Nature Biotechnology, Jan. 2015, vol. 33, No. 1, pp. 73-80.
Addgene Plasmid No. 44246, downloaded Aug. 23, 2023.
Addgene Plasmid No. 73021, downloaded Aug. 23, 2023.
Addgene Plasmid No. 79620, downloaded Aug. 23, 2023.
Aratyn-Schaus et al., "[589] Base-Editing as a Therapeutic Approach for the Direct Correction of Disease-Causing Mutations Underlying Glycogen Storage Disease Type IA," AASLD Abstracts (Poster), Hepatology, Oct. 2020, vol. 72, No. Suppl. 1, pp. 354A-355A.
Azad et al., "Site-directed RNA editing by adenosine deaminase acting on RNA for correction of the genetic code in gene therapy," Gene Therapy, 2017, vol. 24, pp. 779-786.
Baligar et al., "Bone Marrow Stem Cell Therapy Partially Ameliorates Pathological Consequences in Livers of Mice Expressing Mutant Human α1-Antitrypsin," Hepatology, Apr. 2017, vol. 65, No. 4, pp. 1319-1335.
Bjursell et al., "Therapeutic Genome Editing With CRISPR/Cas9 in a Humanized Mouse Model Ameliorates α1-antitrypsin Deficiency Phenotype," EBioMedicine, 2018, vol. 29, pp. 104-111.
Burstein et al., "New CRISPR-Cas systems from uncultivated microbes," Nature, Feb. 9, 2017, vol. 542, Article No. 7640, pp. 237-241 and pp. 242-264 containing Methods, Extended Data, and Figures (28 total pages).
Canver et al., "Customizing the genome as therapy for the β-hemoglobinopathies," Blood, May 26, 2016, vol. 127, No. 21, pp. 2536-2545.
Chadwick et al., "In Vivo Base Editing of PCSK9 (Proprotein Convertase Subtilisin/Kexin Type 9) as a Therapeutic Alternative to Genome Editing," Arteriosclerosis, Thrombosis, and Vascular Biology, Sep. 2017, vol. 37, Article No. 9, pp. 1741-1747.
Cheng et al., "Cloning, expression and activity identification of human innate immune protein apolipoprotein B mRNA editing enzyme catalytic subunit 3A (APOBEC3A)," Chinese Journal of Cellular and Molecular Immunology, 2017, vol. 33, No. 2, pp. 179-184 [English Abstract].
Chester et al., "The apolipoprotein B mRNA editing complex performs a multifunctional cycle and suppresses nonsense-mediated decay," The EMBO Journal, 2003, vol. 22, No. 15, pp. 3971-3982.
Fine et al., "Trans-spliced Cas9 allows cleavage of HBB and CCR5 genes in human cells using compact expression cassettes," Scientific Reports, 2015, vol. 5, No. 10777, pp. 1-9.
Fitzhugh et al., "At least 20% donor myeloid chimerism is necessary to reverse the sickle phenotype after allogeneic HSCT," Blood, Oct. 26, 2017, vol. 130, No. 17, pp. 1946-1948.

(56) References Cited

OTHER PUBLICATIONS

Fonfara et al., "Phylogeny of Cas9 determines functional exchangeability of dual-RNA and Cas9 among orthologous type II CRISPR-Cas systems," Nucleic Acids Research, 2014, vol. 42, No. 4, pp. 2577-2590.
GenBank Locus No. LC169509.1, downloaded Aug. 10, 2023.
GenBank NCBI Reference Sequence No. NM_000295.4, downloaded Aug. 23, 2023.
Hess et al., "Methods and Applications of CRISPR-Mediated Base Editing in Eukaryotic Genomes," Molecular Cell, Oct. 5, 2017, vol. 68, pp. 26-43.
Jha et al., "Single amino acid substitutions in recombinant plant-derived human α1-proteinase inhibitor confer enhanced stability and functional efficacy," Biochimica et Biophysica Acta, 2014, vol. 1840, pp. 416-427.
Kaya et al., "A bacterial Argonaute with noncanonical guide RNA specificity," Proceedings of the National Academy of Sciences of the United States of America, Apr. 12, 2016, vol. 113, No. 15, pp. 4057-4062.
Kim et al., "Increasing the genome-targeting scope and precision of base editing with engineered Cas9-cytidine deaminase fusions," Nature Biotechnology, Apr. 2017, vol. 35, Article No. 4, pp. 371-376 and pp. 377-385 containing Online Methods, Supplementary Material, Acknowledgments, References and Figures (15 total pages).
Kitamura et al., "Uracil DNA Glycosylase Counteracts APOBEC3G-Induced Hypermutation of Hepatitis B Viral Genomes: Excision Repair of Covalently Closed Circular Dna," PLoS Pathogens, May 2013, vol. 9, No. 5, e1003361, pp. 1-14.
Kleinstiver et al., "Broadening the targeting range of *Staphylococcus aureus* CRISPR-Cas9 by modifying PAM recognition," Nature Biotechnology, Dec. 2015, vol. 33, Article No. 12, pp. 1293-1298 and p. 1299 containing Online Methods (7 total pages).
Komor et al., "CRISPR-Based Technologies for the Manipulation of Eukaryotic Genomes," Cell, Jan. 12, 2017, vol. 168, pp. 20-36.
Kury et al., "De Novo Disruption of the Proteasome Regulatory Subunit PSMD12 Causes a Syndromic Neurodevelopmental Disorder," The American Journal of Human Genetics, Feb. 2, 2017, vol. 100, pp. 352-363.
Lei et al., "Glucose-6-phosphatase dependent substrate transport in the glycogen storage disease type-1a mouse," Nature Genetics, Jun. 1996, vol. 13, pp. 203-209.
Ma et al., "Targeted AID-mediated mutagenesis (TAM) enables efficient genomic diversification in mammalian cells," Nature Methods, Dec. 2016, vol. 13, No. 12, pp. 1029-1035 and pp. 1036-1037 containing Online Methods (9 total pages).
Musallam et al., "Fetal hemoglobin levels and morbidity in untransfused patients with β-thalassemia intermedia," Blood, Jan. 12, 2012, vol. 119, No. 2, pp. 364-367.
Ngo et al., "Fetal haemoglobin levels and haematological characteristics of compound heterozygotes for haemoglobin S and deletional hereditary persistence of fetal haemoglobin," British Journal of Haematology, 2011, vol. 156, pp. 259-264.
Okumura et al., "Evolutionary paths of streptococcal and staphylococcal superantigens," BMC Genomics, 2012, vol. 13, No. 404, pp. 1-16.
Plosky, Brian S., "CRISPR-Mediated Base Editing without DNA Double-Strand Breaks," Molecular Cell, May 19, 2016, vol. 62, pp. 477-478.
Pournasr et al., "Modeling Inborn Errors of Hepatic Metabolism Using Induced Pluripotent Stem Cells," Arteriosclerosis, Thrombosis, and Vascular Biology, 2017, vol. 37, pp. 1994-1999.
Putnam et al., "Protein Mimicry of DNA from Crystal Structures of the Uracil-DNA Glycosylase Inhibitor Protein and its Complex with *Escherichia coli* Uracil-DNA Glycosylase," Journal of Molecular Biology, 1999, vol. 287, pp. 331-346.
Rajamohan et al., "Current status of drug screening and disease modelling in human pluripotent stem cells," Bioessays, 2012, vol. 35, pp. 281-298.
Ribeiro et al., "Protein Engineering Strategies to Expand CRISPR-Cas9 Applications," Hindawi: International Journal of Genomics, 2018, vol. 2018, No. 1652567, pp. 1-12.
Ryu et al., "Adenine base editing in mouse embryos and an adult mouse model of Duchenne muscular dystrophy," Nature Biotechnology, Jun. 2018, vol. 36, No. 6, pp. 536-539.
Sangkitporn et al., "Hb G Makassar (Beta 6: Glu→Ala) in a Thai family," Journal of the Medical Association of Thailand, May 2002, vol. 85, No. 5, pp. 577-582.
Shah et al., "Efficient and versatile CRISPR engineering of human neurons in culture to model neurological disorders," Version 1, Wellcome Open Research, Nov. 15, 2016, vol. 1, No. 13, pp. 1-18 and pp. 19-21 containing Open Peer Review (21 total pages).
Shah et al., "MeCP2 mutations: progress towards understanding and treating Rett syndrome," Genome Medicine, 2017, vol. 9, No. 17, pp. 1-4.
Shen et al., "Amelioration of Alpha-1 Antitrypsin Deficiency Diseases with Genome Editing in Transgenic Mice," Human Gene Therapy, 2018, vol. 29, No. 8, pp. 861-873.
Shimomura et al., "Complete genome sequencing and analysis of a Lancefield group G *Streptococcus dysgalactiae* subsp. equisimilis strain causing streptococcal toxic shock syndrome (Stss)," BMC Genomics, 2011, vol. 12, No. 17, pp. 1-17.
Smith et al., "Efficient and Allele-Specific Genome Editing of Disease Loci in Human IPSCs," Molecular Therapy, Mar. 2015, vol. 23, No. 3, pp. 570-577.
Teng et al., "Mutational analysis of apolipoprotein B mRNA editing enzyme (APOBEC1): structure-function relationships of RNA editing and dimerization," Journal of Lipid Research, 1999, vol. 40, pp. 623-635.
Truong et al., "Development of an intein-mediated split-Cas9 system for gene therapy," Nucleic Acids Research, 2015, vol. 43, No. 13, pp. 6450-6458.
UniProt Proteome ID No. UP000009215, downloaded Aug. 14, 2023.
Wang et al., "Enhanced base editing by co-expression of free uracil DNA glycosylase inhibitor," Cell research, Oct. 2017, vol. 27, No. 10, pp. 1289-1292.
Werder et al., "Adenine base editing reduces misfolded protein accumulation and toxicity in alpha-1 antitrypsin deficient patient iPSC-hepatocytes," Molecular Therapy, Nov. 2021, vol. 29, No. 11, pp. 3219-3229.
Wienert et al., "KLF1 drives the expression of fetal hemoglobin in British HPFH," Blood, Aug. 10, 2017, vol. 130, No. 6, pp. 803-807.
Wijesinghe et al., "Efficient deamination of 5-methylcytosines in DNA by human APOBEC3A, but not by AID or APOBEC3G," Nucleic Acids Research, 2012, vol. 40, No. 18, pp. 9206-9217.
Zhang et al., "Progress in base editing technology based on CRISPR/Cas9 system and its application in medical research," Chinese Journal of Pharmacology and Toxicology, Jul. 2018, vol. 32, No. 7, pp. 507-514 [English Abstract].
Hiu et al., "Evolved Cas9 variants with broad PAM compatibility and high DNA specificity," Nature, Apr. 5, 2018, vol. 556, pp. 57-63.
Ekstrand et al., "Frequent alterations of the PI3K/AKT/mTOR pathways in hereditary nonpolyposis colorectal cancer," Familial Cancer, 2010, vol. 9, pp. 125-129.
Lavergne et al., "Defects in type IIA von Willebrand disease: a cysteine 509 to arginine substitution in the mature von Willebrand factor disrupts a disulphide loop involved in the interaction with platelet glycoprotein lb-IX," British Journal of Haematology, 1992, vol. 82, pp. 66-72.
UniProt Accession No. A0A5F1IHX6, downloaded Apr. 11, 2023.
UniProt Accession No. A8AD26, downloaded Apr. 11, 2023.
Yan et al., "High-efficiency and multiplex adenine base editing in plants using new TadA variants," Molecular Plant, May 3, 2021, vol. 14, pp. 722-731.
Grunewald et al., "Transcriptome-wide off-target RNA editing induced by CRISPR-guided DNA base editors," Nature, May 16, 2019, vol. 569, pp. 433-437.
Hua et al., "Expanding the base editing scope in rice by using Cas9 variants," Plant Biotechnology Journal, 2019, vol. 17, pp. 499-504.

(56) References Cited

OTHER PUBLICATIONS

Huang et al., "Circularly permuted and PAM-modified Cas9 variants broaden the targeting scope of base editors," Nature Biotechnology, Jun. 2019, vol. 37, pp. 626-631.
Jin et al., "Cytosine, but not adenine, base editors induce genome-wide off-target mutations in rice," Science, Apr. 19, 2019, vol. 364, pp. 292-295.
Lee et al., "CRISPR-Pass: Gene Rescue of Nonsense Mutations Using Adenine Base Editors," Molecular Therapy, Aug. 2019, vol. 27, No. 8, pp. 1364-1371.
Lee et al., "Cytosine but not adenine base editor generates mutations in mice," bioRxiv, 2019, pp. 1-24.
Ran et al., "In vivo genome editing using *Staphylococcus aureus* Cas9," Nature, Apr. 9, 2015, vol. 520, No. 7546, pp. 186-191.
Rees et al., "Improving the DNA specificity and applicability of base editing through protein engineering and protein delivery," Nature Communications, 2017, vol. 8, No. 15790, pp. 1-10.
Tsai et al., "GUIDE-seq enables genome-wide profiling of off-target cleavage by CRISPR-Cas nucleases," Nature Biotechnology, Feb. 2015, vol. 33, No. 2, pp. 187-197.
Yang et al., "Increasing targeting scope of adenosine base editors in mouse and rat embryos through fusion of TadA deaminase with Cas9 variants," Protein & Cell, 2018, vol. 9, No. 9, pp. 814-819.
Yeh et al., "In vivo base editing of post-mitotic sensory cells," Nature Communications, 2018, vol. 9, No. 2184, pp. 1-10.
Zhou et al., "Off-target RNA mutation induced by DNA base editing and its elimination by mutagenesis," Nature, Jul. 11, 2019, vol. 571, pp. 275-277.
Zuo et al., "Cytosine base editor generates substantial off-target singlenucleotide variants in mouse embryos," Science, vol. Apr. 19, 2019, vol. 364, No. 6437, pp. 289-292.
Extended European Search Report dated Jul. 15, 2022 in corresponding European Patent Application No. 19857653.0 (21 pages).
Doudna, Jennifer A., "The Promise and Challenge of Therapeutic Genome Editing," Nature, Feb. 2020, vol. 578, Article No. 7794, pp. 229-236 and pp. 20-24 containing Figures (24 total pages).
GenBank Accession No. AIT42264.1, downloaded Jan. 9, 2024.
GenBank Accession No. AKA60242.1, downloaded Jan. 9, 2024.
GenBank Accession No. AKQ21048.1, downloaded Jan. 9, 2024.
GenBank Accession No. AKS40380.1, downloaded Jan. 9, 2024.
GenBank Protein No. 4UN5_B, downloaded Jan. 9, 2024.
Greene et al., "Alpha-1 Antitrypsin Deficiency: Recent Developments in Gene Therapy Research," Gene Therapy Application, 2011, vol. 25, pp. 449-460.
Hendel et al., "Chemically modified guide RNAs enhance CRISPR-Cas genome editing in human primary cells," Nature Biotechnology, Sep. 2015, vol. 33, Article No. 9, pp. 985-989 and pp. 13-14 containing Figures (14 total pages).
Lin et al., "[Construction and evaluation of DnaB split intein high expression vector and a six amino acids cyclic peptide library]," Chinese Journal of Biotechnology, Nov. 1, 2008, vol. 24, No. 11, pp. 1924-1930 [English Abstract Only].
Ma et al., "Integration and exchange of split dCas9 domains for transcriptional controls in mammalian cells," Nature Communications, 2016, vol. 7, Article No. 13056, pp. 1-7.
Micozzi et al., "Human cytidine deaminase: A biochemical characterization of its naturally occurring variants," International Journal of Biological Macromolecules, Feb. 2014, vol. 63, pp. 64-74 and pp. 75-91 containing Acknowledgments, Abbreviations, References, and Figures (28 total pages).
NCBI Reference Sequence No. NC_000001.11, downloaded Jan. 9, 2024.
NCBI Reference Sequence No. NP_000286.3, downloaded Sep. 27, 2023.
NCBI Reference Sequence No. WP_002989955.1, downloaded Jan. 9, 2024.
NCBI Reference Sequence No. WP_010922251.1, downloaded Jan. 9, 2024.
NCBI Reference Sequence No. WP_011054416.1, downloaded Jan. 9, 2024.
NCBI Reference Sequence No. WP_011284745.1, downloaded Jan. 9, 2024.
NCBI Reference Sequence No. WP_011285506.1, downloaded Jan. 9, 2024.
NCBI Reference Sequence No. WP_011527619.1, downloaded Jan. 9, 2024.
NCBI Reference Sequence No. WP_012560673.1, downloaded Jan. 9, 2024.
NCBI Reference Sequence No. WP_014407541.1, downloaded Jan. 9, 2024.
NCBI Reference Sequence No. WP_020905136.1, downloaded Jan. 9, 2024.
NCBI Reference Sequence No. WP_023080005.1, downloaded Jan. 9, 2024.
NCBI Reference Sequence No. WP_023610282.1, downloaded Jan. 9, 2024.
NCBI Reference Sequence No. WP_030125963.1, downloaded Jan. 9, 2024.
NCBI Reference Sequence No. WP_030126706.1, downloaded Jan. 9, 2024.
NCBI Reference Sequence No. WP_031488318.1, downloaded Jan. 9, 2024.
NCBI Reference Sequence No. WP_032460140.1, downloaded Jan. 9, 2024.
NCBI Reference Sequence No. WP_032461047.1, downloaded Jan. 9, 2024.
NCBI Reference Sequence No. WP_032462016.1, downloaded Jan. 9, 2024.
NCBI Reference Sequence No. WP_032462936.1, downloaded Jan. 9, 2024.
NCBI Reference Sequence No. WP_032464890.1, downloaded Jan. 9, 2024.
NCBI Reference Sequence No. WP_038431314.1, downloaded Jan. 9, 2024.
NCBI Reference Sequence No. WP_038432938.1, downloaded Jan. 9, 2024.
NCBI Reference Sequence No. WP_038434062.1, downloaded Jan. 9, 2024.
NCBI Reference Sequence No. WP_048327215.1, downloaded Jan. 9, 2024.
NCBI Reference Sequence No. WP_049519324.1, downloaded Jan. 9, 2024.
Qianqian, Xiong, "Advances in Diagnosis and Treatment of Glycogen Storage Diseases," Journal of Stroke and Neurological Diseases, 2017, vol. 34, No. 10, pp. 957-960 [English Abstract].
Qing et al., "Research progress on double-stranded RNA-specific adenosine deaminase—DSRAD/ADAR1," Foreign Medical Sciences, 2004, vol. 3, pp. 129-132 [English Abstract Only].
Ramakrishna et al., "Gene disruption by cell-penetrating peptide-mediated delivery of Cas9 protein and guide RNA," Genome Research, 2014, vol. 24, pp. 1020-1027.
Sinnamon et al., "Site-directed RNA repair of endogenous Mecp2 RNA in neurons," Proceedings of the National Academy of Sciences of the United States of America, Oct. 16, 2017, pp. E9395-E9402.
UniProt Accession No. P51908, Downloaded Jan. 9, 2024.
Valdmanis et al., "Future of rAAV Gene Therapy: Platform for RNAi, Gene Editing, and Beyond," Human Gene Therapy, 2017, vol. 28, No. 4, pp. 361-372.
Yuliang et al., "Diagnosis and treatment of α1-antitrypsin deficiency," Practical Clinical Medicine, 2017, vol. 2, pp. 104-107 [English Abstract Only].
Alexandrov et al., "Signatures of mutational processes in human cancer," Nature, Aug. 22, 2013, vol. 500, pp. 415-421.
Andries et al., "N1-methylpseudouridine-incorporated mRNA outperforms pseudouridine-incorporated mRNA by providing enhanced protein expression and reduced immunogenicity in mammalian cell lines and mice," Journal of Controlled Release, 2015, vol. 217, pp. 337-344.
Bae et al., "Cas-OFFinder: a fast and versatile algorithm that searches for potential off-target sites of Cas9 RNA-guided endonucleases," Bioinformatics, Jan. 24, 2014, vol. 30, No. 10, pp. 1473-1475.

(56) References Cited

OTHER PUBLICATIONS

Billon et al., "CRISPR-Mediated Base Editing Enables Efficient Disruption of Eukaryotic Genes through Induction of STOP Codons," Molecular Cell, Sep. 21, 2017, vol. 67, pp. 1068-1079.
Branden and Tooze, "The Building Blocks," Introduction to Protein Structure, 1999, vol. 2, pp. 3-12.
Briner et al., "Guide RNA Functional Modules Direct Cas9 Activity and Orthogonality," Molecular Cell, Oct. 23, 2014, vol. 56, pp. 333-339.
Bulow et al., "Multienzyme systems obtained by gene fusion," Trends in Biotechnology, Jan. 1991, vol. 9, pp. 226-231.
Cameron, Ewan R., "Recent Advances in Transgenic Technology," Molecular Biotechnology, 1997, vol. 7, pp. 253-265.
Chatterjee et al., "A Cas9 with PAM recognition for adenine dinucleotides," Nature Communications, 2020, vol. 11, No. 2474, pp. 1-6.
Chichili et al., "Linkers in the structural biology of protein-protein interactions," Protein Science, 2013, vol. 22, pp. 153-167.
Chylinski et al., "The tracrRNA and Cas9 families of type II CRISPR-Cas immunity systems," RNA Biology, May 2013, vol. 10, No. 5, pp. 726-737.
Collantes et al., "Development and Characterization of a Modular CRISPR and RNA Aptamer Mediated Base Editing System," The CRISPR Journal, 2021, vol. 4, No. 1, pp. 58-68.
Cong et al., "Multiplex Genome Engineering Using CRISPR/Cas Systems," Science, Feb. 15, 2013, vol. 339, No. 6121, pp. 819-823.
Deltcheva et al., "Crispr RNA maturation by trans-encoded small RNA and host factor RNase III," Nature, Mar. 31, 2011, vol. 471, pp. 602-607.
Endo et al., "Toward establishing an efficient and versatile gene targeting system in higher plants," Biocatalysis and Agricultural Biotechnology, 2014, vol. 3, pp. 2-6.
Ferretti et al., "Complete genome sequence of an M1 strain of *Streptococcus pyogenes*," Proceedings of the National Academy of Sciences of the United States of America, Apr. 10, 2001, vol. 98, No. 8, pp. 4658-4663.
Freshney et al., "Culture of Animal Cells, A Manual of Basic Technique," Food and Chemical Toxicology, 1983, vol. 23, No. 3, pp. 403-404.
Fu et al., "Human cell based directed evolution of adenine base editors with improved efficiency," Nature Communications, 2021, vol. 12, No. 5897, pp. 1-11.
Gardlik et al., "Vectors and delivery systems in gene therapy," Medical Science Monitor, 2005, vol. 11, No. 4, pp. RA110-RA121.
Gasiunas et al., "Cas9-crRNA ribonucleoprotein complex mediates specific DNA cleavage for adaptive immunity in bacteria," Proceedings of the National Academy of Sciences of the United States of America, Sep. 4, 2012, pp. E2579-E2586.
Gasiunas et al., "RNA-dependent DNA endonuclease Cas9 of the CRISPR system: Holy Grail of genome editing?" Trends in Microbiology, Nov. 2013, vol. 21, No. 11, pp. 562-567.
Gaudelli et al., "Directed evolution of adenine base editors with increased activity and therapeutic application," Nature Biotechnology, 2020, pp. 1-15.
Gaudelli et al., "Programmable base editing of A•T to G•C in genomic DNA without DNA cleavage," Nature, Nov. 23, 2017, vol. 551, pp. 464-471.
Grunewald et al., "Crispr DNA base editors with reduced RNA off-target and self-editing activities," Nature Biotechnology, Sep. 2019, vol. 37, No. 9, pp. 1041-1048.
Guilinger et al., "Fusion of catalytically inactive Cas9 to FokI nuclease improves the specificity of genome modification," Nature Biotechnology, 2014, pp. 1-6.
Guo et al., "Protein tolerance to random amino acid change," Proceedings of the National Academy of Sciences of the United States of America, Jun. 22, 2004, vol. 101, No. 25, pp. 9205-9210.
Hill et al., "Functional Analysis of Conserved Histidines in ADP-Glucose Pyrophosphorylase from *Escherichia coli*," Biochemical Biophysical Research Communications, 1998, vol. 244, No. 2, pp. 573-577.

Houdebine, Louis-Marie, "The methods to generate transgenic animals and to control transgene expression," Journal of Biotechnology, 2002, vol. 98, pp. 145-160.
Hu et al., "Evolved Cas9 variants with broad PAM compatibility and high DNA specificity," Nature, Apr. 5, 2018, vol. 556, pp. 57-63.
Huang et al., "DNA epigenome editing using CRISPR-Cas SunTag-directed DNMT3A," Genome Biology, 2017, vol. 18, No. 176, pp. 1-11.
Jeong et al., "Adenine base editor engineering reduces editing of bystander cytosines," Nature Biotechnology, 2021, pp. 1-12.
Jeong et al., "Precise adenine base editors that exhibit minimized cytosine catalysis," Research Square, 2020, pp. 1-15.
Jiang et al., "Chemical modifications of adenine base editor mRNA and guide RNA expand its application scope," Nature Communications, 2020, vol. 11, No. 1979, pp. 1-9.
Jinek et al., "A Programmable Dual-RNA—Guided DNA Endonuclease in Adaptive Bacterial Immunity," Science, Aug. 17, 2012, vol. 337, No. 6096, pp. 816-821.
Jinek et al., "RNA-programmed genome editing in human cells," eLife, 2013, vol. 2, No. e00471, pp. 1-9.
Jore et al., "Structural basis for CRISPR RNA-guided DNA recognition by Cascade," Nature Structural & Molecular Biology, May 2011, vol. 18, No. 5, pp. 529-537.
Kappel et al., "Regulating gene expression in transgenic animals," Current Opinion in Biotechnology, 1992, vol. 3, pp. 548-553.
Kim et al., "Adenine base editors catalyze cytosine conversions in human cells," Nature Biotechnology, Oct. 2019, vol. 37, pp. 1145-1148.
Kim et al., "Highly efficient RNA-guided genome editing in human cells via delivery of purified Cas9 ribonucleoproteins," Genome Research, 2014, vol. 24, pp. 1012-1019.
Kim et al., "Rescue of high-specificity Cas9 variants using sgRNAs with matched 5' nucleotides," Genome Biology, 2017, vol. 18, No. 218, pp. 1-6.
Kim et al., "Transcriptional Repression by Zinc Finger Peptides," The Journal of Biological Chemistry, Nov. 21, 1997, vol. 272, No. 47, pp. 29795-29800.
Kim et al., "Structural and Kinetic Characterization of *Escherichia coli* TadA, the Wobble-Specific TRNA Deaminase," Biochemistry, 2006, vol. 45, No. 20, pp. 6407-6416.
Kleinstiver et al., "Broadening *Staphylococcus aureus* Cas9 Targeting Range by Modifying PAM Recognition," Nature Biotechnology, Dec. 2015, vol. 33, No. 12, pp. 1293-1298.
Kleinstiver et al., "Engineered CRISPR-Cas9 nucleases with altered PAM specificities," Nature, Jul. 23, 2015, vol. 523, pp. 481-485.
Kleinstiver et al., "High-fidelity CRISPR-Cas9 variants with undetectable genome-wide off-targets," Molecular Therapy, Jan. 28, 2016, vol. 529, No. 75187, pp. 490-495.
Koblan et al., "Improving cytidine and adenine base editors by expression optimization and ancestral reconstruction," Nature Biotechnology, 2018, pp. 1-4.
Komor et al., "Improved base excision repair inhibition and bacteriophage Mu Gam protein yields C:G-to-T:A base editors with higher efficiency and product purity," Science Advances, Aug. 30, 2017, vol. 3, No. eaao4774, pp. 1-9.
Komor et al., "Programmable editing of a target base in genomic DNA without double-stranded DNA cleavage," Nature, May 19, 2016, vol. 533, pp. 420-424.
Kundu et al., "Leucine to proline substitution by SNP at position 197 in Caspase-9 gene expression leads to neuroblastoma: a bioinformatics analysis," 3 Biotech, 2013, vol. 3, pp. 225-234.
Lapinaite et al., "DNA capture by a CRISPR-Cas9—guided adenine base editor," Science, Jul. 31, 2020, vol. 369, No. 6503, pp. 566-571.
Cartegni et al., "Determinants of Exon 7 Splicing in the Spinal Muscular Atrophy Genes, SMN1 and SMN2," The American Journal of Human Genetics, Jan. 2006, vol. 78, pp. 63-77.
Chang et al., "Degradation of survival motor neuron (SMN) protein is mediated via the ubiquitin/proteasome pathway," Neurochemistry International, 2004, vol. 45, pp. 1107-1112.
Charpentier et al. "Rewriting a genome", Nature, Mar. 2013, vol. 495, No. 7439, pp. 50-51.

(56) References Cited

OTHER PUBLICATIONS

Chen et al. "Targeting genomic rearrangements in tumor cells through Cas9-mediated insertion of a suicide gene." Nature Biotechnology, Jun. 2017, vol. 35, No. 6, pp. 543-552.
Cho et al., "A degron created by SMN2 exon 7 skipping is a principal contributor to spinal muscular atrophy severity," Genes & Development, 2010, vol. 24, pp. 438-442.
Corcia et al., "The importance of the SMN genes in the genetics of sporadic ALS," Amyotrophic Lateral Sclerosis, 2009, vol. 10, pp. 436-440.
Corti et al., "Genetic Correction of Human Induced Pluripotent Stem Cells from Patients with Spinal Muscular Atrophy," Science Translational Medicine, Dec. 19, 2012, vol. 4, Article No. 165, pp. 1-20 and pp. 21-32 containing Figures (32 total pages).
Cucchiarini et al., "Enhanced expression of the central survival of motor neuron (SMN) protein during the pathogenesis of osteoarthritis," Journal of Cellular and Molecular Medicine, 2014, vol. 18, No. 1, pp. 115-124.
De Souza. "Primer: genome editing with engineered nucleases." Nature Methods, vol. 9, No. 1, Jan. 2012, pp. 27-27.
D'Ydewalle et al., "The Antisense Transcript SMN-AS1 Regulates SMN Expression and Is a Novel Therapeutic Target for Spinal Muscular Atrophy," Neuron, Jan. 4, 2017, vol. 93, pp. 63-79.
Gaudelli et al., "Programmable Base Editing of A•T to G•C in Genomic DNA without DNA Cleavage," Nature, Nov. 23, 2017, vol. 551, pp. 464-471 and pp. 472-487 containing Methods, Figures, Life Sciences Reporting Summary and Corrections & Amendments (24 total pages).
GenBank Accession No. CTS26096.1, downloaded Apr. 9, 2024.
Geneseq, "*Streptococcus pyogenes* Cas9 protein", XP002808136, retrieved from EBI accession No. GSP: BIR16744 Database accession No. BIR16744 sequence—& DATBSE Geneseq [Online], Jan. 21, 2021.
Geneseq, "*Streptococcus pyogenes* Cas9 protein", XP002808135, retrieved from EBI accession No. GSP: BIR16747 Database accession No. BIR16747 sequence—& DATBSE Geneseq [Online], Jan. 21, 2021.
Geneseq, "Adenine deaminase polypeptide SEQ: 49.", XP002808137, retrieved from EBI accession No. GSP: BJG44493 Database accession No. BJG44493 sequence—& DATBSE Geneseq [Online], Jun. 10, 2021.
Grimm et al., In vitro and in vivo Gene Therapy Vector Evolution via Multispecies Interbreeding and Retargeting of Adeno-Associated Viruses. J. Virol., 2008, vol. 82, p. 5887-5911.
Jeong et al., "Measurement of deoxyinosine adduct: Can it be a reliable tool to assess oxidative or nitrosative DNA damage?," Toxicology Letters, 2012, vol. 214, pp. 226-233.
Kleinstiver et al., "Engineered CRISPR-Cas9 nucleases with altered PAM specificities," Nature, Jul. 23, 2015, vol. 523, Article No. 7561, pp. 481-485 and pp. 24-27 containing Figures (27 total pages).
Komor et al., "Programmable Editing of a Target Base in Genomic DNA without Double-Stranded DNA Cleavage," Nature, May 19, 2016, vol. 533, pp. 420-424 and pp. 425-436 containing Methods and Figures (17 total pages).
Le et al., "SMNΔ7, the major product of the centromeric survival motor neuron (SMN2) gene, extends survival in mice with spinal muscular atrophy and associates with full-length SMN," Human Molecular Genetics, 2005, vol. 14, No. 6, pp. 845-857.
Lefebvre et al., "Identification and Characterization of a Spinal Muscular Atrophy-Determining Gene," Jan. 13, 1995, vol. 80, pp. 155-165.
Liu, et al. "Crossing the blood-brain barrier with AAV vectors," Metabolic Brain Disease, 2021, vol. 36, pp. 45-52.
Lorson et al., "A single nucleotide in the SMN gene regulates splicing and is responsible for spinal muscular atrophy," Proceedings of the National Academy of Sciences of the United States of America, May 1999, vol. 96, pp. 6307-6311.
Lutz et al., "Postsymptomatic restoration of SMN rescues the disease phenotype in a mouse model of severe spinal muscular atrophy," The Journal of Clinical Investigation, Aug. 2011, vol. 121, No. 8, pp. 3029-3041.
Maeder et al. "CRISPR RNA-guided activation of endogenous human genes", Nature Methods, Oct. 2013, vol. 10, No. 10, pp. 977-979.
Monani et al., "A single nucleotide difference that alters splicing patterns distinguishes the SMA gene SMN1 from the copy gene SMN2," Human Molecular Genetics, 1999, vol. 8, No. 7, pp. 1177-1183.
Murray et al., "Selective vulnerability of motor neurons and dissociation of pre- and post-synaptic pathology at the neuromuscular junction in mouse models of spinal muscular atrophy," Human Molecular Genetics, 2008, vol. 17, No. 7, pp. 949-962.
NCBI Reference Sequence No. WP_001297409.1, downloaded Aug. 14, 2023.
NCBI Reference Sequence No. WP_032188360.1, downloaded Apr. 9, 2024.
Nelson et al., "In vivo genome editing improves muscle function in a mouse model of Duchenne muscular dystrophy," Science, Jan. 22, 2016, vol. 351, No. 6271, pp. 403-407.
Newby et al. "Base editing of haematopoietic stem cells rescues sickle cell disease in mice", Nature, Nature Publishing Group UK, London, 2021, vol. 595, Article No. 7866, pp. 295-302, p. 296; Figure 1, p. 301.
O'Connell et al., Programmable RNA recognition and cleavage by CRISPR/Cas9. Nature, 2014, vol. 516, p. 263-266.
Ousterout et al., "Multiplex CRISPR/Cas9-based genome editing for correction of dystrophin mutations that cause Duchenne muscular dystrophy," Nature Communications, Feb. 2015, vol. 6, No. 6244, pp. 1-13.
Pattanayak et al., "High-throughput profiling of off-target DNA cleavage reveals RNA-programmed Cas9 nuclease specificity," Nature Biotechnology, Sep. 2013, vol. 31, No. 9, pp. 839-843.
Ranzau et al., "The wild-type tRNA adenosine deaminase enzyme TadA is capable of sequence-specific DNA base editing." Chembiochem, Aug. 2023, vol. 24, No. 16, pp. 1-35.
Riesenberg et al. "Improved gRNA secondary structures allow editing of target sites resistant to CRISPR-Cas9 cleavage." Nature communications, 2022, vol. 13 No. 1, pp. 489.
Ruffolo, et al., "Design of highly functional genome editors by modeling of the universe of CRISPR-Cas Sequences," bioRxiv, posted Apr. 22, 2024, doi: 10.1101/2024.04.22.590591.
Schrank et al., "Inactivation of the survival motor neuron gene, a candidate gene for human spinal muscular atrophy, leads to massive cell death in early mouse embryos," Proceedings of the National Academy of Sciences of the United States of America, Sep. 1997, vol. 94, pp. 9920-9925.
Singh et al., "Splicing of a Critical Exon of Human Survival Motor Neuron Is Regulated by a Unique Silencer Element Located in the Last Intron," Molecular and Cellular Biology, Feb. 2006, vol. 26, No. 4, pp. 1333-1346.
Song et al. "Delivery of CRISPR/Cas systems for cancer gene therapy and immunotherapy." Advanced Drug Delivery Reviews, 2021, vol. 168, pp. 150-180.
Stanton et al. "Systemic administration of novel engineered AAV capsids facilitates enhanced transgene expression in the macaque CNS." Med, 2023, vol. 4. no. 1, pp. 31-50.
Talbot et al., "Spinal muscular atrophy," Journal of Inherited Metabolic Disease, Jun. 2001, vol. 21, No. 2, pp. 189-197 [Abstract Only].
Thorpe et al. "Functional Correction of Episomal Mutations With Short DNA Fragments and RNA-DNA Oligonucleotides." Journal of Gene Medicine, Jan. 2002, vol. 4, No. 1, pp. 195-204.
Tipanee, et al. "Transposons: Moving Forward from Preclinical Studies to Clinical Trials," Human Gene Therapy, Nov. 2017, pp. 1087-1104.
Tsai et al. "Dimeric CRISPR RNA-guided FokI nucleases for highly specific genome editing." Nature Biotechnology, Apr. 2014, vol. 32, No. 6, pp. 569-576.
UniProt Accession No. Q6JC40, Downloaded Nov. 14, 2024.

(56) References Cited

OTHER PUBLICATIONS

Wan et al. "Material solutions for delivery of CRISPR/Cas-based genome editing tools: current status and future outlook." Materials Today, Jun. 2019, vol. 26, pp. 40-66.

Wirth et al., "Mildly affected patients with spinal muscular atrophy are partially protected by an increased SMN2 copy number," Human Genetics, 2006, vol. 119, pp. 422-428.

Zhou et al., "Cas 12a variants designed for lower genome-wide off-target effect through stringent PAM recognition", Molecular Therapy, Jan. 2022, vol. 30, No. 1, pp. 1-12.

* cited by examiner

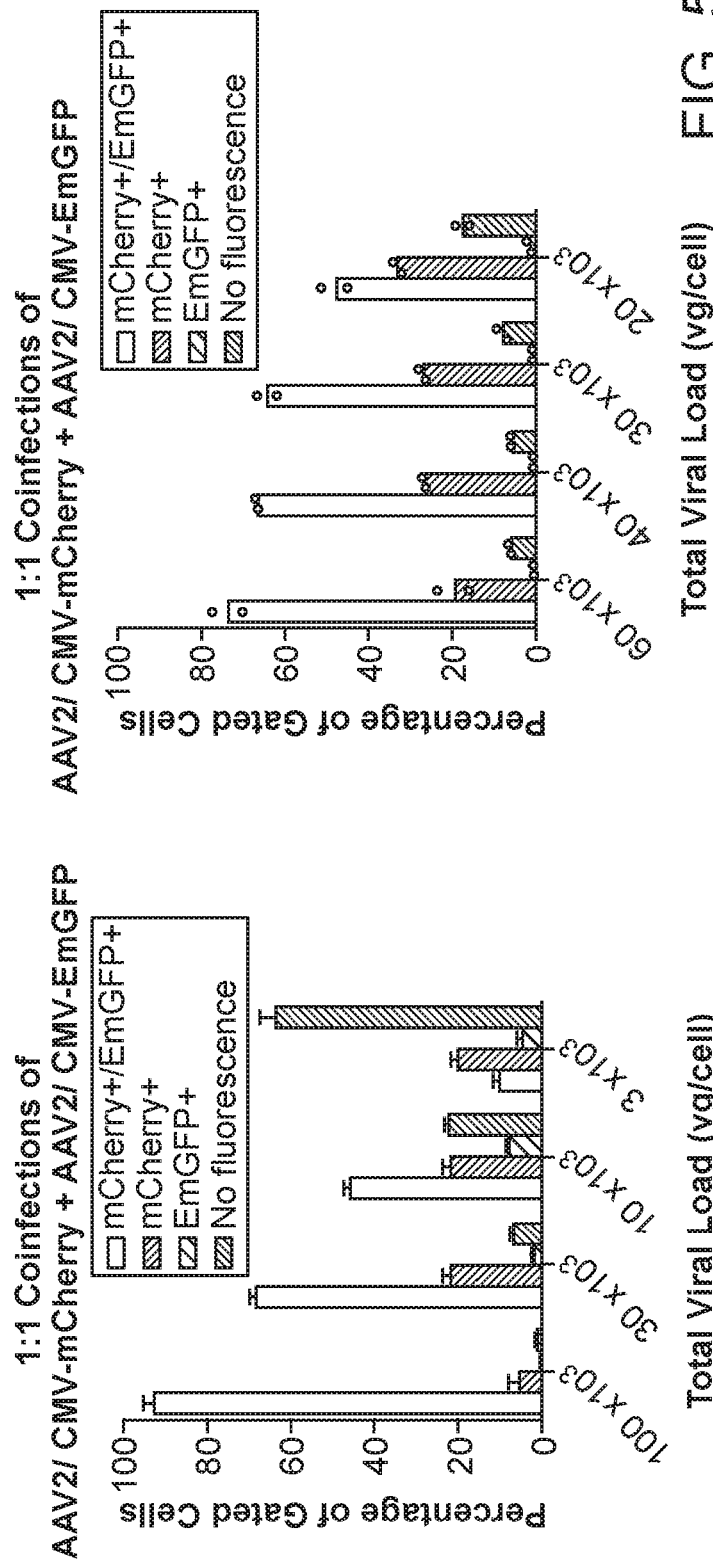
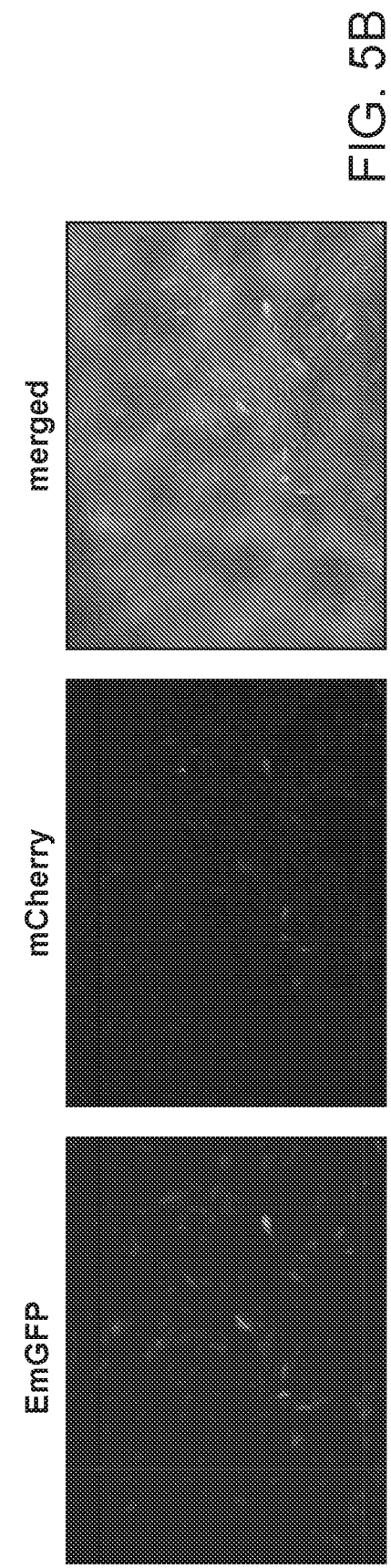
FIG. 5A
FIG. 5B

COMPOSITIONS AND METHODS FOR DELIVERING A NUCLEOBASE EDITING SYSTEM

CROSS-REFERENCE TO RELATED APPLICATION

This application is the U.S. national phase application, pursuant to 35 U.S.C. § 371, of PCT International Application No.: PCT/US2019/050111, filed Sep. 7, 2019, designating the United States and published in English, which claims the benefit of U.S. Provisional Patent Application No. 62/728,703, filed on Sep. 7, 2018, and U.S. Provisional Patent Application No. 62/779,404, filed on Dec. 13, 2018, the entire contents of each of which are hereby incorporated by reference herein.

SEQUENCE LISTING

The instant application contains a Sequence Listing which has been submitted electronically in ASCII format and is hereby incorporated by reference in its entirety. Said ASCII copy, created on Oct. 10, 2019, is named 180802.041403_SL.txt and is 796,575 bytes in size.

BACKGROUND OF THE INVENTION

Discovery of the Clustered Regularly-Interspaced Short Palindromic Repeats (CRISPR) has revolutionized the field of molecular biology. Much of this enthusiasm centers on the clinical potential of CRISPR/Cas9 for treating human disease and editing the human genome. Disease-causing mutations could potentially be repaired using CRISPR or CRISPR-based systems. One challenge to accomplishing this goal is delivery of the elements needed for genome editing. For example, with regard to CRISPR/Cas9, SpCas9 and sgRNA can be encoded in a DNA plasmid vector and delivered via adeno-associated virus (AAV). However due to the small packaging capacity of AAVs, it is difficult to include other elements (such as polypeptide domains, promoters, reporters, fluorescent tags, multiple sgRNAs, or DNA templates for HDR) to help achieve delivery of CRISPR/Cas9 components to cells and/or to meet desired gene editing objectives.

SUMMARY OF THE INVENTION

In some aspects, provided herein is a composition comprising (a) a first polynucleotide encoding a fusion protein comprising a deaminase and an N-terminal fragment of Cas9, wherein the N-terminal fragment of Cas9 starts at the N-terminus of Cas9 and is a contiguous sequence that terminates at a position between A292-G364 of Cas9 as numbered in SEQ ID NO: 2, wherein the N-terminal fragment of Cas9 is fused to a split intein-N, and (b) a second polynucleotide encoding a C-terminal fragment of Cas9, wherein the C-terminal fragment of Cas9 starts at a position between A292-G364 of Cas9 as numbered in SEQ ID NO: 2 and is a contiguous sequence that terminates at the C-terminus of Cas9, and wherein the C-terminal fragment of Cas9 is fused to a split intein-C.

In some aspects, provided herein is a composition comprising (a) a first polynucleotide encoding a fusion protein comprising a deaminase and an N-terminal fragment of Cas9, wherein the N-terminal fragment of Cas9 starts at the N-terminus of Cas9 and is a contiguous sequence that terminates at a position between A292-G364, F445-K483, or E565-T637 of Cas9 as numbered in SEQ ID NO: 2, wherein the N-terminal fragment of Cas9 is fused to a split intein-N, and (b) a second polynucleotide encoding a C-terminal fragment of Cas9, wherein the C-terminal fragment of Cas9 starts at a position between A292-G364, F445-K483, or E565-T637 of Cas9 as numbered in SEQ ID NO: 2 and is a contiguous sequence that terminates at the C-terminus of Cas9, wherein the N-terminus residue of the C-terminal fragment of Cas9 is a Cys substituted for an Ala, Ser, or Thr, and wherein the C-terminal fragment of Cas9 is fused to a split intein-C.

In some aspects, provided herein is a composition comprising (a) a first polynucleotide encoding an N-terminal fragment of Cas9, wherein the N-terminal fragment of Cas9 starts at the N-terminus of Cas9 and is a contiguous sequence that terminates at a position between A292-G364, F445-K483, or E565-T637 of Cas9 as numbered in SEQ ID NO: 2, wherein the N-terminal fragment of Cas9 is fused to a split intein-N, and (b) a second polynucleotide encoding a fusion protein comprising a C-terminal fragment of Cas9 and a deaminase, wherein the C-terminal fragment of Cas9 starts at a position between A292-G364, F445-K483, or E565-T637 of Cas9 as numbered in SEQ ID NO: 2 and is a contiguous sequence that terminates at the C-terminus of Cas9, wherein the N-terminus residue of the C-terminal fragment of Cas9 is a Cys substituted for an Ala, Ser, or Thr, and wherein the C-terminal fragment of Cas9 is fused to a split intein-C.

In some embodiments, the N-terminal fragment of the Cas9 comprises up to amino acid 302, 309, 312, 354, 455, 459, 462, 465, 471, 473, 576, 588, or 589 as numbered in SEQ ID NO: 2. In some embodiments, the C-terminal fragment of Cas9 or the N-terminal fragment of Cas9 comprises an Ala/Cys, Ser/Cys, or Thr/Cys mutation at a residue corresponding to amino acid S303, T310, T313, S355, A456, S460, A463, T466, S469, T472, T474, C574, S577, A589, or S590 as numbered in SEQ ID NO: 2. In some embodiments, the composition further comprises a single guide RNA (sgRNA) or a polynucleotide encoding the sgRNA. In some embodiments, the first and the second polynucleotides are joined. In some embodiments, the first and the second polynucleotides are expressed separately. In some embodiments, the deaminase is an adenosine deaminase. In some embodiments, the deaminase is a wild-type TadA or TadA7.10. In some embodiments, the deaminase is a TadA dimer. In some embodiments, the TadA dimer comprises a wild-type TadA and a TadA 7.10. In some embodiments, the fusion protein comprises a nucleus localization signal (NLS). In some embodiments, the N-terminal fragment of Cas9 or the C-terminal fragment of Cas9 is joined with a NLS. In some embodiments, the NLS is a bipartite NLS. In some embodiments, the N-terminal fragment of Cas9 and the fusion protein are joined to form a base editor protein comprising a deaminase and a SpCas9. In some embodiments, the C-terminal fragment of Cas9 and the fusion protein are joined to form a base editor protein comprising a deaminase and a SpCas9. In some embodiments, the SpCas9 has nickase activity or is catalytically inactive.

In some aspects, provided herein is a composition comprising the fusion protein and the N-terminal fragment of Cas9 disclosed herein. In some aspects, provided herein is a composition comprising the fusion protein and the C-terminal fragment of Cas9 disclosed herein. In some embodiments, the N terminal fragment of Cas9 or the C terminal fragment of Cas9 and the deaminase are joined by a linker. In some embodiments, the linker is a peptide linker.

In some aspects, provided herein is a vector comprising the first and the second polynucleotide disclosed herein. In some embodiments, the vector comprises a promoter. In some embodiments, the promoter is a constitutive promoter. In some embodiments, the constitutive promoter is a CMV or CAG promoter. In some embodiments, the vector is selected from the group consisting of retroviral vectors, adenoviral vectors, lentiviral vectors, herpesvirus vectors, and adeno-associated viral vectors. In some embodiments, the vector is an adeno-associated viral vector.

In some aspects, provided herein is a cell comprising the composition disclosed herein, or the vector disclosed herein. In some embodiments, the cell is a mammalian cell. In some aspects, provided herein is a reconstituted A-to-G base editor protein comprising a Cas9 domain comprising an Ala/Cys, Ser/Cys, or Thr/Cys mutation. In some embodiments, the mutation is at a residue corresponding to SpCas9 amino acid S303, T310, T313, S355, A456, S460, A463, T466, S469, T472, T474, C574, S577, A589, or S590. In some aspects, provided herein is a composition comprising one or more polynucleotides encoding (a) an N-terminal fragment of Cas9, wherein the N-terminal fragment of Cas9 starts at the N-terminus of Cas9 and is a contiguous sequence that terminates at a position between A292-G364 of Cas9 as numbered in SEQ ID NO: 2, and wherein the N-terminal fragment of Cas9 is fused to a split intein-N, and (b) a C-terminal fragment of Cas9, wherein the C-terminal fragment of Cas9 starts at a position between A292-G364 of Cas9 as numbered in SEQ ID NO: 2 and is a contiguous sequence that terminates at the C-terminus of Cas9, and wherein the C-terminal fragment of Cas9 is fused to a split intein-C.

In some aspects, provided herein is a composition comprising one or more polynucleotides encoding (a) an N-terminal fragment of Cas9, wherein the N-terminal fragment of Cas9 starts at the N-terminus of Cas9 and is a contiguous sequence that terminates at amino acid 302, 309, 312, 354, 455, 459, 462, 465, 471, 473, 576, 588, or 589 of Cas9 as numbered in SEQ ID NO: 2, and wherein the N-terminal fragment of Cas9 is fused to a split intein-N, and (b) a C-terminal fragment of Cas9, wherein the C-terminal fragment of Cas9 starts at 303, 310, 313, 355, 456, 460, 463, 466, 472, 474, 577, 589, or 590 of Cas9 as numbered in SEQ ID NO: 2 and is a contiguous sequence that terminates at the C-terminus of Cas9, and wherein the C-terminal fragment of Cas9 is fused to a split intein-C.

In some embodiments, the N-terminal fragment of Cas9 or the C-terminal fragment of Cas9 is joined with a nucleus localization signal (NLS). In some embodiments, the N-terminal fragment of Cas9 and the C-terminal fragment of Cas9 are both joined with a NLS. In some embodiments, the NLS is a bipartite NLS. In some embodiments, the N-terminal fragment of Cas9 and the C-terminal fragment of Cas9 are joined to form a SpCa9. In some embodiments, the SpCas9 has nickase activity or is catalytically inactive.

In some aspects, provided herein is a composition comprising the N-terminal fragment of Cas9 in (a) and the C-terminal fragment of Cas9 in (b) disclosed herein. In some aspects, provided herein is a vector comprising the one or more polynucleotides disclosed herein. In some embodiments, the vector comprises a promoter. In some embodiments, the promoter is a constitutive promoter. In some embodiments, the constitutive promoter is a CMV or CAG promoter. In some embodiments, the vector is selected from the group consisting of retroviral vectors, adenoviral vectors, lentiviral vectors, herpesvirus vectors, and adeno-associated viral vectors. In some embodiments, the vector is an adeno-associated viral vector.

In some aspects, provided herein is a cell comprising the composition disclosed herein, or the vector disclosed herein. In some embodiments, the cell is a mammalian cell. In some aspects, provided herein is a Cas9 variant polypeptide comprising a Ala/Cys, Ser/Cys, or Thr/Cys mutation. In some aspects, provided herein is a Cas9 variant polypeptide comprising a Cys residue at amino acid 303, 310, 313, 355, 456, 460, 463, 466, 472, or 474. In some aspects, provided herein is a method for delivering a base editor system to a cell, the method comprising contacting the cell with (a) a first polynucleotide encoding a fusion protein comprising a deaminase and an N-terminal fragment of Cas9, wherein the N-terminal fragment of Cas9 starts at the N-terminus of Cas9 and is a contiguous sequence that terminates at a position between A292-G364 of Cas9 as numbered in SEQ ID NO: 2, wherein the N-terminal fragment of Cas9 is fused to a split intein-N, (b) a second polynucleotide encoding a C-terminal fragment of Cas9, wherein the C-terminal fragment of Cas9 starts at a position between A292-G364 of Cas9 as numbered in SEQ ID NO: 2 and is a contiguous sequence that terminates at the C-terminus of Cas9, and wherein the C-terminal fragment of Cas9 is fused to a split intein-C, and (c) a single guide RNA (sgRNA) or a polynucleotide encoding the sgRNA.

In some aspects, provided herein is a method for delivering a base editor system to a cell, the method comprising contacting the cell with (a) a first polynucleotide encoding a fusion protein comprising an N-terminal fragment of Cas9, wherein the N-terminal fragment of Cas9 starts at the N-terminus of Cas9 and is a contiguous sequence that terminates at a position between A292-G364 of Cas9 as numbered in SEQ ID NO: 2, wherein the N-terminal fragment of Cas9 is fused to a split intein-N, (b) a second polynucleotide encoding a C-terminal fragment of Cas9 and a deaminase, wherein the C-terminal fragment of Cas9 starts at a position between A292-G364 of Cas9 as numbered in SEQ ID NO: 2 and is a contiguous sequence that terminates at the C-terminus of Cas9, and wherein the C-terminal fragment of Cas9 is fused to a split intein-C, and (c) a single guide RNA (sgRNA) or a polynucleotide encoding the sgRNA.

In some aspects, provided herein is a method for delivering a Base Editor System to a cell, the method comprising contacting the cell with (a) a first polynucleotide encoding a fusion protein comprising a deaminase and an N-terminal fragment of Cas9, wherein the N-terminal fragment of Cas9 starts at the N-terminus of Cas9 and is a contiguous sequence that terminates at a position between A292-G364, F445-K483, or E565-T637 of Cas9 as numbered in SEQ ID NO: 2, wherein the N-terminal fragment of Cas9 is fused to a split intein-N, (b) a second polynucleotide encoding a C-terminal fragment of Cas9, wherein the C-terminal fragment of Cas9 starts at a position between A292-G364, F445-K483, or E565-T637 of Cas9 as numbered in SEQ ID NO: 2 and is a contiguous sequence that terminates at the C-terminus of Cas9, wherein the N-terminus residue of the C-terminal fragment of Cas9 is a Cys substituted for an Ala, Ser, or Thr, and wherein the C-terminal fragment of Cas9 is fused to a split intein-C, and (c) a single guide RNA (sgRNA) or a polynucleotide encoding the sgRNA.

In some aspects, provided herein is a method for delivering a Base Editor System to a cell, the method comprising contacting the cell with (a) a first polynucleotide encoding a fusion protein comprising an N-terminal fragment of Cas9, wherein the N-terminal fragment of Cas9 starts at the N-terminus of Cas9 and is a contiguous sequence that terminates at a position between A292-G364, F445-K483, or E565-T637 of Cas9 as numbered in SEQ ID NO: 2, wherein the N-terminal fragment of Cas9 is fused to a split intein-N, (b) a second polynucleotide encoding a C-terminal fragment of Cas9 and a deaminase, wherein the C-terminal fragment of Cas9 starts at a position between A292-G364, F445-K483, or E565-T637 of Cas9 as numbered in SEQ ID NO: 2 and is a contiguous sequence that terminates at the C-terminus of Cas9, wherein the N-terminus residue of the C-terminal fragment of Cas9 is a Cys substituted for an Ala, Ser, or Thr, and wherein the C-terminal fragment of Cas9 is fused to a split intein-C, and (c) a single guide RNA (sgRNA) or a polynucleotide encoding the sgRNA.

In some embodiments, the sgRNA is complementary to a target polynucleotide. In some embodiments, the target polynucleotide is present in the genome of an organism. In some embodiments, the organism is an animal, plant, or bacteria. In some embodiments, first polynucleotides, the second polynucleotide, and/or the polynucleotide encoding the are contacted with the cell via a vector. In some embodiments, the vector is selected from the group consisting of retroviral vectors, adenoviral vectors, lentiviral vectors, herpesvirus vectors, and adeno-associated viral vectors. In some embodiments, the vector is an adeno-associated viral vector. In some embodiments, the C-terminal fragment of Cas9 or the N-terminal fragment of Cas9 comprises an Ala/Cys, Ser/Cys, or Thr/Cys mutation at a residue corresponding to amino acid S303, T310, T313, S355, A456, S460, A463, T466, S469, T472, T474, C574, S577, A589, or S590 as numbered in SEQ ID NO: 2. In some embodiments, the deaminase is an adenosine deaminase. In some embodiments, the deaminase is a TadA or a variant thereof. In some embodiments, the deaminase is a wild-type TadA or Tad7.10. In some embodiments, the deaminase is a TadA dimer. In some embodiments, the TadA dimer comprises a wild type TadA and a TadA7.10. In some embodiments, the N-terminal fragment of Cas9 or the C-terminal fragment of Cas9 comprises an NLS. In some embodiments, the N-terminal fragment of Cas9 and the C-terminal fragment of Cas9 both comprise an NLS. In some embodiments, the NLS is a bipartite NLS. In some embodiments, the N-terminal fragment of Cas9 and the C-terminal fragment of Cas9 are joined to form a SpCa9. In some embodiments, the SpCas9 has nickase activity or is catalytically inactive.

In some aspects, provided herein is a polynucleotide encoding a fusion protein, wherein the fusion protein comprises a deaminase and an N-terminal fragment of Cas9, wherein the N-terminal fragment of Cas9 starts at the N-terminus of Cas9 and is a contiguous sequence that terminates at a position between A292-G364 of Cas9 as numbered in SEQ ID NO: 2, and wherein the N-terminal fragment of Cas9 is fused to a split intein-N. In some aspects, provided herein is a polynucleotide encoding a fusion protein, wherein the fusion protein comprises a deaminase and an N-terminal fragment of Cas9, wherein the N-terminal fragment of Cas9 starts at the N-terminus of Cas9 and is a contiguous sequence that terminates at a position between F445-K483 of Cas9 as numbered in SEQ ID NO: 2, and wherein the N-terminal fragment of Cas9 is fused to a split intein-N. In some aspects, provided herein is a polynucleotide encoding a fusion protein, wherein the fusion protein comprises a deaminase and an N-terminal fragment of Cas9, wherein the N-terminal fragment of Cas9 starts at the N-terminus of Cas9 and is a contiguous sequence that terminates at a position between E565-T637 of Cas9 as numbered in SEQ ID NO: 2, and wherein the N-terminal fragment of Cas9 is fused to a split intein-N. In some aspects, provided herein is a polynucleotide encoding a fusion protein, wherein the fusion protein comprises a deaminase and a C-terminal fragment of Cas9, wherein the C-terminal fragment of Cas9 starts at a position between A292-G364 of Cas9 as numbered in SEQ ID NO: 2 and is a contiguous sequence that terminates at the C-terminus of Cas9, and wherein the C-terminal fragment of Cas9 is fused to a split intein-C. In some aspects, provided herein is a polynucleotide encoding a fusion protein, wherein the fusion protein comprises a deaminase and a C-terminal fragment of Cas9, wherein the C-terminal fragment of Cas9 starts at a position between F445-K483 of Cas9 as numbered in SEQ ID NO: 2 and is a contiguous sequence that terminates at the C-terminus of Cas9, and wherein the C-terminal fragment of Cas9 is fused to a split intein-C. In some aspects, provided herein is a polynucleotide encoding a fusion protein, wherein the fusion protein comprises a deaminase and a C-terminal fragment of Cas9, wherein the C-terminal fragment of Cas9 starts at a position between E565-T637 of Cas9 as numbered in SEQ ID NO: 2 and is a contiguous sequence that terminates at the C-terminus of Cas9, and wherein the C-terminal fragment of Cas9 is fused to a split intein-C. In some aspects, provided herein is a polynucleotide encoding a fusion protein, wherein the fusion protein comprises a deaminase and a C-terminal fragment of Cas9, wherein the C-terminal fragment of Cas9 starts at a position between A292-G364, F445-K483, or E565-T637 of Cas9 as numbered in SEQ ID NO: 2 and is a contiguous sequence that terminates at the C-terminus of Cas9, wherein the N-terminus residue of the C-terminal fragment of Cas9 is a Cys substituted for an Ala, Ser, or Thr, and wherein the C-terminal fragment of Cas9 is fused to a split intein-C.

In some embodiments, the C-terminal fragment of Cas9 or the N-terminal fragment of Cas9 comprises an Ala/Cys, Ser/Cys, or Thr/Cys mutation. In some embodiments, the mutation is at a residue corresponding to amino acid S303, T310, T313, S355, A456, S460, A463, T466, S469, T472, T474, C574, S577, A589, or S590 as numbered in SEQ ID NO: 2. In some embodiments, the deaminase is an adenosine deaminase. In some embodiments, the deaminase is a TadA or a variant thereof. In some embodiments, the deaminase is a wild-type TadA, or Tad7.10. In some embodiments, the fusion protein comprises two deaminases linked to each other. In some embodiments, the fusion protein comprises both a wild type TadA and a TadA7.10. In some embodiments, the fusion protein comprises an NLS. In some embodiments, the NLS is a bipartite NLS. In some embodiments, the N-terminal fragment of Cas9 or the C-terminal fragment of Cas9 comprises amino acid sequence of SpCas9. In some embodiments, the N-terminal fragment of Cas9 or the C-terminal fragment of Cas9 comprises one or more amino acid substitutions associated with reduced nuclease activity.

In some aspects, provided herein is an N-terminal fragment of a Cas9 protein comprising up to amino acid 302, 309, 312, 354, 455, 459, 462, 465, 471, or 473 fused to a split intein-N. In some aspects, provided herein is a C-terminal protein fragment of a Cas9 protein, wherein the N-terminus amino acid of the C-terminal fragment is a Cys substitution at amino acid 303, 310, 313, 355, 456, 460, 463, 466, 472, or 474 and is fused to a split intein-C. In some aspects, provided herein is a polynucleotide encoding a fragment of an A-to-G Base Editor fusion protein, the fusion protein comprising one or more deaminases and an N-terminal fragment of Cas9, wherein the N-terminal fragment is fused to a split intein-N. In some aspects, provided herein is a polynucleotide encoding a fragment of an A-to-G Base Editor fusion protein, the fusion protein comprising one or more deaminases and a C-terminal fragment of Cas9, wherein the C-terminal fragment is fused to a split intein-C. In some aspects, provided herein is a protein fragment of an A-to-G Base Editor fusion protein, the fusion protein comprising one or more deaminases and an N-terminal fragment of Cas9, wherein the N-terminal fragment is fused to a split intein-N. In some aspects, provided herein is a protein fragment of an A-to-G Base Editor fusion protein, the fusion protein comprising one or more deaminases and a C-terminal fragment of Cas9, wherein the C-terminal fragment is fused to a split intein-C.

In some aspects, provided herein is a composition comprising first and second polynucleotides each encoding a fragment of an A-to-G Base Editor fusion protein comprising one or more deaminases and Cas9, wherein the first polynucleotide encodes an N-terminal fragment of Cas9 fused to a split intein-N and the second polynucleotide encodes a C-terminal fragment of Cas9 fused to a split intein-C. In some aspects, provided herein is a composition comprising N- and C terminal fragments of an A-to-G Base Editor fusion protein comprising one or more deaminases and SpCas9, wherein the N-terminal fragment comprises a fragment of SpCas9 fused to a split intein-N and the C-terminal fragment comprises the remainder of SpCas9 fused to a split intein-C.

In some aspects, provided herein is a method for delivering a Base Editor System to a cell, the method comprising contacting a cell with first and second polynucleotides each encoding a fragment of an A-to-G Base Editor fusion protein comprising one or more deaminases and Cas9, wherein the first polynucleotide encodes an N-terminal fragment of Cas9 fused to a split intein-N and the second polynucleotide encodes a C-terminal fragment of Cas9 fused to a split intein-C, and either the first or the second polynucleotide encodes a single guide RNA. In some aspects, provided herein is a method for delivering a Base Editor System to a cell, the method comprising contacting a cell with N- and C terminal fragments of an A-to-G Base Editor fusion protein comprising one or more deaminases and SpCas9, wherein the N-terminal fragment comprises a fragment of SpCas9 fused to a split intein-N and the C-terminal fragment comprises the remainder of SpCas9 fused to a split intein-C, and a guide RNA. In some aspects, provided herein is a method for editing a target polynucleotide in a cell, the method comprising contacting a cell with first and second polynucleotides each encoding a fragment of an A-to-G Base Editor fusion protein comprising one or more deaminases and Cas9, wherein the first polynucleotide encodes an N-terminal fragment of Cas9 fused to a split intein-N and the second polynucleotide encodes a C-terminal fragment of Cas9 fused to a split intein-C, and either the first or the second polynucleotide encodes a single guide RNA, and expressing the encoded proteins and single guide RNA in the cell.

Other features and advantages of the invention will be apparent from the detailed description, and from the claims.

Definitions

Unless defined otherwise, all technical and scientific terms used herein have the meaning commonly understood by a person skilled in the art to which this invention belongs. The following references provide one of skill with a general definition of many of the terms used in this invention: Singleton et al., Dictionary of Microbiology and Molecular Biology (2nd ed. 1994); The Cambridge Dictionary of Science and Technology (Walker ed., 1988); The Glossary of Genetics, 5th Ed., R. Rieger et al. (eds.), Springer Verlag (1991); and Hale & Marham, The Harper Collins Dictionary of Biology (1991). As used herein, the following terms have the meanings ascribed to them below, unless specified otherwise.

By "adenosine deaminase" is meant a polypeptide or fragment thereof capable of catalyzing the hydrolytic deamination of adenine or adenosine. In some embodiments, the deaminase or deaminase domain is an adenosine deaminase catalyzing the hydrolytic deamination of adenosine to inosine or deoxy adenosine to deoxyinosine. In some embodiments, the adenosine deaminase catalyzes the hydrolytic deamination of adenine or adenosine in deoxyribonucleic acid (DNA). The adenosine deaminases (e.g. engineered adenosine deaminases, evolved adenosine deaminases) provided herein may be from any organism, such as a bacterium. In some embodiments, the deaminase or deaminase domain is a variant of a naturally-occurring deaminase from an organism. In some embodiments, the deaminase or deaminase domain does not occur in nature. For example, in some embodiments, the deaminase or deaminase domain is at least 50%, at least 55%, at least 60%, at least 65%, at least 70%, at least 75% at least 80%, at least 85%, at least 90%, at least 95%, at least 96%, at least 97%, at least 98%, at least 99%, or at least 99.5% identical to a naturally-occurring deaminase. In some embodiments, the adenosine deaminase is from a bacterium, such as, *E. coli, S. aureus, S. typhi, S. putrefaciens, H. influenzae*, or *C. crescentus*. In some embodiments, the adenosine deaminase is a TadA deaminase. In some embodiments, the TadA deaminase is an *E. coli* TadA (ecTadA) deaminase or a fragment thereof.

For example, the truncated ecTadA may be missing one or more N-terminal amino acids relative to a full-length ecTadA. In some embodiments, the truncated ecTadA may be missing 1, 2, 3, 4, 5, 6, 7, 8, 9, 10, 11, 12, 13, 14, 15, 6, 17, 18, 19, or 20 N-terminal amino acid residues relative to the full length ecTadA. In some embodiments, the truncated ecTadA may be missing 1, 2, 3, 4, 5, 6, 7, 8, 9, 10, 11, 12, 13, 14, 15, 6, 17, 18, 19, or 20 C-terminal amino acid residues relative to the full length ecTadA. In some embodiments, the ecTadA deaminase does not comprise an N-terminal methionine. In some embodiments, the TadA deaminase is an N-terminal truncated TadA. In particular embodiments, the TadA is any one of the TadA described in PCT/US2017/045381, which is incorporated herein by reference in its entirety.

In certain embodiments, the adenosine deaminase comprises the amino acid sequence:

(SEQ ID NO: 3)
MSEVEFSHEYWMRHALTLAKRAWDEREVPVGAVLVHNNRVIGEGWNRPI
GRHDPTAHAEIMALRQGGLVMQNYRLIDATLYVTLEPCVMCAGAMIHSR
IGRVVFGARDAKTGAAGSLMDVLHHPGMNHRVEITEGILADECAALLSD
FFRMRRQEIKAQKKAQSSTD, which is termed "the TadA reference sequence".

In some embodiments the TadA deaminase is a full-length E. coli TadA deaminase. For example, in certain embodiments, the adenosine deaminase comprises the amino acid sequence:

(SEQ ID NO: 4)
MRRAFITGVFFLSEVEFSHEYWMRHALTLAKRAWDEREVPVGAVLVHNN
RVIGEGWNRPIGRHDPTAHAEIMALRQGGLVMQNYRLIDATLYVTLEPC
VMCAGAMIHSRIGRVVFGARDAKTGAAGSLMDVLHHPGMNHRVEITEGI
LADECAALLSDFFRMRRQEIKAQKKAQSSTD

It should be appreciated, however, that additional adenosine deaminases useful in the present application would be apparent to the skilled artisan and are within the scope of this disclosure. For example, the adenosine deaminase may be a homolog of adenosine deaminase acting on tRNA (ADAT). Exemplary ADAT homologs include, without limitation:

*Staphylococcus aureus* TadA:
(SEQ ID NO: 5)
MGSHMTNDIYFMTLAIEEAKKAAQLGEVPIGAIITKDDEVIARAHNLRETLQQPTAH
AEHIAIERAAKVLGSWRLEGCTLYVTLEPCVMCAGTIVMSRIPRVVYGADDPKGGCS
GS LMNLLQQS NFNHRAIVDKG VLKE AC S TLLTTFFKNLRANKKS TN

*Bacillus subtilis* TadA:
(SEQ ID NO: 6)
MTQDELYMKEAIKEAKKAEEKGEVPIGAVLVINGEIIARAHNLRETEQRSIAHAEML
VIDEACKALGTWRLEGATLYVTLEPCPMCAGAVVLSRVEKVVFGAFDPKGGC S
GTLMN LLQEERFNHQAEVVSGVLEEECGGMLSAFFRELRKKKAARKNLSE

*Salmonella typhimurium* (*S. typhimurium*) TadA:
(SEQ ID NO: 7)
MPPAFITGVTSLSDVELDHEYWMRHALTLAKRAWDEREVPVGAVLVHNHRVIGEG
WNRPIGRHDPTAHAEIMALRQGGLVLQNYRLLDTTLYVTLEPCVMCAGAMVHSRIG
RVVFGARDAKTGAAGSLIDVLHHPGMNHRVEIIEGVLRDECATLLSDFFRMRRQEIK
ALKKADRAEGAGPAV

*Shewanella putrefaciens* (*S. putrefaciens*) TadA:
(SEQ ID NO: 8)
MDE YWMQVAMQM AEKAEAAGE VPVGA VLVKDGQQIATGYNLS IS QHDPT
AHAEI
LCLRSAGKKLENYRLLDATLYITLEPCAMCAGAMVHSRIARVVYGARDEKTGAAGT
VVNLLQHPAFNHQVEVTSGVLAEACSAQLSRFFKRRRDEKKALKLAQRAQQGIE

*Haemophilus influenzae* F3031 (*H. influenzae*) TadA:
(SEQ ID NO: 9)
MDAAKVRSEFDEKMMRYALELADKAEALGEIPVGAVLVDDARNIIGEGWNLSIVQS
DPT AH AEI-
IALRNG AKNIQN YRLLNS TLY VTLEPCTMC AG AILHS RIKRLVFG
AS D YK
TGAIGSRFHFFDDYKMNHTLEITSGVLAEECSQKLSTFFQKRREEKKIEKALLKSLSD
K

*Caulobacter crescentus* (*C. crescentus*) TadA:
(SEQ ID NO: 10)
MRTDESEDQDHRMMRLALDAARAAAEAGETPVGAVILDPSTGEVIATAGNGPIAAH
DPTAHAEIAAMRAAAAKLGNYRLTDLTLVVTLEPCAMCAGAISHARIGRVVFGADD
PKGGAVVHGPKFFAQPTCHWRPEVTGGVLADESADLLRGFFRARRKAKI -continued

*Geobacter sulfurreducens* (*G. sulfurreducens*) TadA:
(SEQ ID NO: 11)
MSSLKKTPIRDDAYWMGKAIREAAKAAARDEVPIGAVIVRDGAVIGRGHNLREGSN

DPSAHAEMIAIRQAARRSANWRLTGATLYVTLEPCLMCMGAIILARLERVVFGCYDP

KGGAAGSLYDLSADPRLNHQVRLSPGVCQEECGTMLSDFFRDLRRRKKAKATPALF

IDERKVPPEP

TadA7.10
(SEQ ID NO: 12)
MSEVEFSHEYWMRHALTLAKRARDEREVPVGAVLVLNNRVIGEGWNRAIGLHDPT

AHAEIMALRQGGLVMQNYRLIDATLYVTFEPCVMCAGAMIHSRIGRVVFGVRNAKT

GAAGSLMDVLHYPGMNHRVEITEGILADECAALLCYFFRMPRQVFNAQKKAQSSTD

By "agent" is meant any small molecule chemical compound, antibody, nucleic acid molecule, or polypeptide, or fragments thereof.

By "alteration" is meant a change in the structure, expression levels or activity of a gene or polypeptide as detected by standard art known methods such as those described herein. As used herein, an alteration (e.g., increase or decrease) includes a 10% change in expression levels, a 25% change, a 40% change, and a 50% or greater change in expression levels.

By "analog" is meant a molecule that is not identical, but has analogous functional or structural features. For example, a polypeptide analog retains at least some of the biological activity of a corresponding naturally-occurring polypeptide, while having certain sequence modifications that enhance the analog's function relative to a naturally occurring polypeptide. Such modifications could increase the analog's protease resistance, membrane permeability, or half-life, without altering, for example, polynucleotide binding activity. In another example, a polynucleotide analog retains the biological activity of a corresponding naturally-occurring polynucleotide while having certain modifications that enhance the analog's function relative to a naturally occurring polynucleotide. Such modifications could increase the polynucleotide's affinity for DNA, half-life, and/or nuclease resistance, an analog may include an unnatural nucleotide or amino acid.

By "base editor (BE)," or "nucleobase editor (NBE)" is meant an agent that binds a polynucleotide and has nucleobase modifying activity. In one embodiment, the agent is a fusion protein comprising a domain having base editing activity, i.e., a domain capable of modifying a base (e.g., A, T, C, G, or U) within a nucleic acid molecule (e.g., DNA). In some embodiments, the domain having base editing activity is capable of deaminating a base within a nucleic acid molecule. In some embodiments, the base editor is capable of deaminating a base within a DNA molecule. In some embodiments, the base editor is capable of deaminating a cytosine (C) or an adenosine within DNA. In some embodiments, the base editor is capable of deaminating a cytosine (C) and an adenosine (A) within DNA. In some embodiments, the base editor is a cytidine base editor (CBE). In some embodiments, the base editor is an adenosine base editor (ABE). In some embodiments, the base editor is an adenosine base editor (ABE) and a cytidine base editor (CBE). In some embodiments, the base editor is a nuclease-inactive Cas9 (dCas9) fused to an adenosine deaminase. In some embodiments, the Cas9 is a circular permutant Cas9 (e.g., spCas9 or saCas9). Circular permutant Cas9s are known in the art and described, for example, in Oakes et al., Cell 176, 254-267, 2019. In some embodiments, the base editor is fused to an inhibitor of base excision repair, for example, a UGI domain. In some embodiments, the fusion protein comprises a Cas9 nickase fused to a deaminase and an inhibitor of base excision repair, such as a UGI domain. In other embodiments the base editor is an abasic base editor.

The nucleobase components and the polynucleotide programmable nucleotide binding component of a base editor system may be associated with each other covalently or non-covalently. For example, in some embodiments, the deaminase domain can be targeted to a target nucleotide sequence by a polynucleotide programmable nucleotide binding domain. In some embodiments, a polynucleotide programmable nucleotide binding domain can be fused or linked to a deaminase domain. In some embodiments, a polynucleotide programmable nucleotide binding domain can target a deaminase domain to a target nucleotide sequence by non-covalently interacting with or associating with the deaminase domain. For example, in some embodiments, the nucleobase editing component, e.g., the deaminase component can comprise an additional heterologous portion or domain that is capable of interacting with, associating with, or capable of forming a complex with an additional heterologous portion or domain that is part of a polynucleotide programmable nucleotide binding domain. In some embodiments, the additional heterologous portion may be capable of binding to, interacting with, associating with, or forming a complex with a polypeptide. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a steril alpha motif, a telomerase Ku binding motif and Ku protein, a telomerase Sm7 binding motif and Sm7 protein, or a RNA recognition motif.

A base editor system may further comprise a guide polynucleotide component. It should be appreciated that components of the base editor system may be associated with each other via covalent bonds, noncovalent interactions, or any combination of associations and interactions thereof. In some embodiments, a deaminase domain can be targeted to a target nucleotide sequence by a guide polynucleotide. For example, in some embodiments, the nucleobase editing component of the base editor system, e.g., the deaminase component, can comprise an additional heterologous portion or domain (e.g., polynucleotide binding domain such as an RNA or DNA binding protein) that is capable of interacting with, associating with, or capable of forming a complex with a portion or segment (e.g., a polynucleotide motif) of a guide polynucleotide. In some embodiments, the additional heterologous portion or domain (e.g., polynucleotide binding domain such as an RNA or DNA binding protein) can be fused or linked to the deaminase domain. In some embodiments, the additional heterologous portion may be capable of binding to, interacting with, associating with, or forming a complex with a polypeptide. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a sterile alpha motif, a telomerase Ku binding motif and Ku protein, a telomerase Sm7 binding motif and Sm7 protein, or a RNA recognition motif.

In some embodiments, a base editor system may comprise one or more proteins, fusion proteins, polypeptides, or encoding polynucleotides thereof. In some embodiments, the base editor system may comprise a first polynucleotide encoding a fusion protein comprising a deaminase and an N-terminal fragment of a napDNAbp and a second polynucleotide encoding a C-terminal fragment of a napDNAbp. For example, in particular embodiments, the N-terminal fragment of the napDNAbp may be fused to a intein-N and the C-terminal fragment of the napDNAbp may be fused to a intein-C, such that the N-terminal fragment and the C-terminal fragment of the napDNAbp may be reconstituted to form a base editor protein.

In some embodiments, a base editor system can further comprise an inhibitor of base excision repair (BER) component. In some embodiments, a base editor system can further comprise an inhibitor of base excision repair (BER) component. It should be appreciated that components of the base editor system may be associated with each other via covalent bonds, noncovalent interactions, or any combination of associations and interactions thereof. The inhibitor of BER component may comprise a base excision repair inhibitor. In some embodiments, the inhibitor of base excision repair can be a uracil DNA glycosylase inhibitor (UGI). In some embodiments, the inhibitor of base excision repair can be an inosine base excision repair inhibitor. In some embodiments, the inhibitor of base excision repair can be targeted to the target nucleotide sequence by the polynucleotide programmable nucleotide binding domain. In some embodiments, a polynucleotide programmable nucleotide binding domain can be fused or linked to an inhibitor of base excision repair. In some embodiments, a polynucleotide programmable nucleotide binding domain can be fused or linked to a deaminase domain and an inhibitor of base excision repair. In some embodiments, a polynucleotide programmable nucleotide binding domain can target an inhibitor of base excision repair to a target nucleotide sequence by non-covalently interacting with or associating with the inhibitor of base excision repair. For example, in some embodiments, the inhibitor of base excision repair component can comprise an additional heterologous portion or domain that is capable of interacting with, associating with, or capable of forming a complex with an additional heterologous portion or domain that is part of a polynucleotide programmable nucleotide binding domain. In some embodiments, the inhibitor of base excision repair can be targeted to the target nucleotide sequence by the guide polynucleotide. For example, in some embodiments, the inhibitor of base excision repair can comprise an additional heterologous portion or domain (e.g., polynucleotide binding domain such as an RNA or DNA binding protein) that is capable of interacting with, associating with, or capable of forming a complex with a portion or segment (e.g., a polynucleotide motif) of a guide polynucleotide. In some embodiments, the additional heterologous portion or domain of the guide polynucleotide (e.g., polynucleotide binding domain such as an RNA or DNA binding protein) can be fused or linked to the inhibitor of base excision repair. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a sterile alpha motif, a telomerase Ku binding motif and Ku protein, a telomerase Sm7 binding motif and Sm7 protein, or a RNA recognition motif. By "base editing activity" is meant acting to chemically alter a base within a polynucleotide. In one embodiment, a first base is converted to a second base. In another embodiment, a base is excised from a polynucleotide. In one embodiment, the base editing activity is cytidine deaminase activity, e.g., converting target C·G to T·A. In another embodiment, the base editing activity is adenosine deaminase activity, e.g., converting A·T to G·C.

The term "Cas9" or "Cas9 domain" refers to an RNA-guided nuclease comprising a Cas9 protein, or a fragment thereof (e.g., a protein comprising an active, inactive, or partially active DNA cleavage domain of Cas9, and/or the gRNA binding domain of Cas9). A Cas9 nuclease is also referred to sometimes as a casn1 nuclease or a CRISPR (clustered regularly interspaced short palindromic repeat)-associated nuclease. CRISPR is an adaptive immune system that provides protection against mobile genetic elements (viruses, transposable elements and conjugative plasmids). CRISPR clusters contain spacers, sequences complementary to antecedent mobile elements, and target invading nucleic acids. CRISPR clusters are transcribed and processed into CRISPR RNA (crRNA). In type II CRISPR systems, correct processing of pre-crRNA requires a trans-encoded small RNA (tracrRNA), endogenous ribonuclease 3 (rnc) and a Cas9 protein. The tracrRNA serves as a guide for ribonuclease 3-aided processing of pre-crRNA. Subsequently, Cas9/crRNA/tracrRNA endonucleolytically cleaves linear or circular dsDNA target complementary to the spacer. The target strand not complementary to crRNA is first cut endonucleolytically, then trimmed 3'-5' exonucleolytically. Single guide RNAs ("sgRNA", or simply "gNRA") can be engineered so as to incorporate aspects of both the crRNA and tracrRNA into a single RNA species. See, e.g., Jinek M., Chylinski K., Fonfara I., Hauer M., Doudna J.A., Charpentier E. Science 337:816-821 (2012), the entire contents of which is hereby incorporated by reference. Cas9 recognizes a short motif in the CRISPR repeat sequences (the PAM or protospacer adjacent motif) to help distinguish self versus non-self. Cas9 nuclease sequences and structures are well known to those of skill in the art (see, e.g., "Complete genome sequence of an M1 strain of *Streptococcus pyogenes*." Ferretti et al., J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., Mclaughlin R. E., Proc. Natl. Acad. Sci. U.S.A. 98:4658-4663 (2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., Nature 471:602-607 (2011); and "A programmable dual-RNA-guided DNA endonuclease in adaptive bacterial immunity." Jinek M., Chylinski K., Fonfara I., Hauer M., Doudna J. A., Charpentier E. Science 337:816-821 (2012), the entire contents of each of which are incorporated herein by reference). Cas9 orthologs have been described in various species, including, but not limited to, *S. pyogenes* and *S. thermophilus*. Additional suitable Cas9 nucleases and sequences will be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) RNA Biology 10:5, 726-737; the entire contents of which are incorporated herein by reference.

A nuclease-inactivated Cas9 protein may interchangeably be referred to as a "dCas9" protein (for nuclease-"dead" Cas9) or catalytically inactive Cas9. Methods for generating a Cas9 protein (or a fragment thereof) having an inactive DNA cleavage domain are known (See, e.g., Jinek et al., Science. 337:816-821 (2012); Qi et al., "Repurposing CRISPR as an RNA-Guided Platform for Sequence-Specific Control of Gene Expression" (2013) Cell. 28;152 (5): 1173-83, the entire contents of each of which are incorporated herein by reference). For example, the DNA cleavage domain of Cas9 is known to include two subdomains, the HNH nuclease subdomain and the RuvCI subdomain. The HNH subdomain cleaves the strand complementary to the gRNA, whereas the RuvCI subdomain cleaves the non-complementary strand. Mutations within these subdomains can silence the nuclease activity of Cas9. For example, the mutations D10A and H840A completely inactivate the nuclease activity of *S. pyogenes* Cas9 (Jinek et al., Science. 337:816-821 (2012); Qi et al., Cell. 28;152 (5): 1173-83 (2013)). In some embodiments, a Cas9 nuclease has an inactive (e.g., an inactivated) DNA cleavage domain, that is, the Cas9 is a nickase, referred to as an "nCas9" protein (for "nickase" Cas9). In some embodiments, proteins comprising fragments of Cas9 are provided. For example, in some embodiments, a protein comprises one of two Cas9 domains: (1) the gRNA binding domain of Cas9; or (2) the DNA cleavage domain of Cas9. In some embodiments, proteins comprising Cas9 or fragments thereof are referred to as "Cas9 variants." A Cas9 variant shares homology to Cas9, or a fragment thereof. For example, a Cas9 variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to wild type Cas9. In some embodiments, the Cas9 variant may have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more amino acid changes compared to wild type Cas9. In some embodiments, the Cas9 variant comprises a fragment of Cas9 (e.g., a gRNA binding domain or a DNA-cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild type Cas9. In some embodiments, the fragment is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild type Cas9.

In some embodiments, the fragment is at least 100 amino acids in length. In some embodiments, the fragment is at least 100, 150, 200, 250, 300, 350, 400, 450, 500, 550, 600, 650, 700, 750, 800, 850, 900, 950, 1000, 1050, 1100, 1150, 1200, 1250, or at least 1300 amino acids in length. In some embodiments, wild type Cas9 corresponds to Cas9 from *Streptococcus pyogenes* (NCBI Reference Sequence: NC_017053.1, nucleotide and amino acid sequences as follows).

(SEQ ID NO: 1)

```
ATGGATAAGAAATACTCAATAGGCTTAGATATCGGCACAAATAGCGTCGGATGGGCGGTGAT

CACTGATGATTATAAGGTTCCGTCTAAAAAGTTCAAGGTTCTGGGAAATACAGACCGCCACA

GTATCAAAAAAATCTTATAGGGGCTCTTTTATTTGGCAGTGGAGAGACAGCGGAAGCGACT

CGTCTCAAACGGACAGCTCGTAGAAGGTATACACGTCGGAAGAATCGTATTTGTTATCTACA

GGAGATTTTTTCAAATGAGATGGCGAAAGTAGATGATAGTTTCTTTCATCGACTTGAAGAGT

CTTTTTTGGTGGAAGAAGACAAGAAGCATGAACGTCATCCTATTTTTGGAAATATAGTAGAT

GAAGTTGCTTATCATGAGAAATATCCAACTATCTATCATCTGCGAAAAAAATTGGCAGATTC

TACTGATAAAGCGGATTTGCGCTTAATCTATTTGGCCTTAGCGCATATGATTAAGTTTCGTG
```

-continued

```
GTCATTTTTTGATTGAGGGAGATTTAAATCCTGATAATAGTGATGTGGACAAACTATTTATC

CAGTTGGTACAAATCTACAATCAATTATTTGAAGAAAACCCTATTAACGCAAGTAGAGTAGA

TGCTAAAGCGATTCTTTCTGCACGATTGAGTAAATCAAGACGATTAGAAAATCTCATTGCTC

AGCTCCCCGGTGAGAAGAGAAATGGCTTGTTTGGGAATCTCATTGCTTTGTCATTGGGATTG

ACCCCTAATTTTAAATCAAATTTTGATTTGGCAGAAGATGCTAAATTACAGCTTTCAAAGA

TACTTACGATGATGATTAGATAATTTATTGGCGCAAATTGGAGATCAATATGCTGATTTGT

TTTTGGCAGCTAAGAATTTATCAGATGCTATTTTACTTTCAGATATCCTAAGAGTAAATAGT

GAAATAACTAAGGCTCCCCTATCAGCTTCAATGATTAAGCGCTACGATGAACATCATCAAGA

CTTGACTCTTTTAAAAGCTTTAGTTCGACAACAACTTCCAGAAAAGTATAAAGAAATCTTTT

TTGATCAATCAAAAAACGGATATGCAGGTTATATTGATGGGGAGCTAGCCAAGAAGAATTT

TATAAATTTATCAAACCAATTTTAGAAAAAATGGATGGTACTGAGGAATTATTGGTGAAACT

AAATCGTGAAGATTTGCTGCGCAAGCAACGGACCTTTGACAACGGCTCTATTCCCCATCAAA

TTCACTTGGGTGAGCTGCATGCTATTTTGAGAAGACAAGAAGACTTTTATCCATTTTTAAAA

GACAATCGTGAGAAGATTGAAAAAATCTTGACTTTTCGAATTCCTTATTATGTTGGTCCATT

GGCGCGTGGCAATAGTCGTTTTGCATGGATGACTCGGAAGTCTGAAGAAACAATTACCCCAT

GGAATTTTGAAGAAGTTGTCGATAAAGGTGCTTCAGCTCAATCATTTATTGAACGCATGACA

AACTTTGATAAAAATCTTCCAAATGAAAAGTACTACCAAAACATAGTTTGCTTTATGAGTA

TTTTACGGTTTATAACGAATTGACAAAGGTCAAATATGTTACTGAGGGAATGCGAAAACCAG

CATTTCTTTCAGGTGAACAGAAGAAAGCCATTGTTGATTTACTCTTCAAAACAAATCGAAAA

GTAACCGTTAAGCAATTAAAAGAAGATTATTTCAAAAAAATAGAATGTTTTGATAGTGTTGA

AATTTCAGGAGTTGAAGATAGATTTAATGCTTCATTAGGCGCCTACCATGATTTGCTAAAAA

TTATTAAAGATAAAGATTTTTTGGATAATGAAGAAAATGAAGATATCTTAGAGGATATTGTT

TTAACATTGACCTTATTTGAAGATAGGGGATGATTGAGGAAAGACTTAAAACATATGCTCA

CCTCTTTGATGATAAGGTGATGAAACAGCTTAAACGTCGCCGTTATACTGGTTGGGGACGTT

TGTCTCGAAAATTGATTAATGGTATTAGGGATAAGCAATCTGGCAAAACAATATTAGATTTT

TTGAAATCAGATGGTTTTGCCAATCGCAATTTTATGCAGCTGATCCATGATGATAGTTTGAC

ATTTAAAGAAGATATTCAAAAAGCACAGGTGTCTGGACAAGGCCATAGTTTACATGAACAGA

TTGCTAACTTAGCTGGCAGTCCTGCTATTAAAAAAGGTATTTTACAGACTGTAAAAATTGTT

GATGAACTGGTCAAAGTAATGGGGCATAAGCCAGAAAATATCGTTATTGAAATGGCACGTGA

AAATCAGACAACTCAAAAGGGCCAGAAAAATTCGCGAGAGCGTATGAAACGAATCGAAGAAG

GTATCAAAGAATTAGGAAGTCAGATTCTTAAAGAGCATCCTGTTGAAAATACTCAATTGCAA

AATGAAAAGCTCTATCTCTATTATCTACAAAATGGAAGAGACATGTATGTGGACCAAGAATT

AGATATTAATCGTTTAAGTGATTATGATGTCGATCACATTGTTCCACAAAGTTTCATTAAAG

ACGATTCAATAGACAATAAGGTACTAACGCGTTCTGATAAAAATCGTGGTAAATCGGATAAC

GTTCCAAGTGAAGAAGTAGTCAAAAAGATGAAAAACTATTGGAGACAACTTCTAAACGCCAA

GTTAATCACTCAACGTAAGTTTGATAATTTAACGAAAGCTGAACGTGGAGGTTTGAGTGAAC

TTGATAAAGCTGGTTTTATCAAACGCCAATTGGTTGAAACTCGCCAAATCACTAAGCATGTG

GCACAAATTTTGGATAGTCGCATGAATACTAAATACGATGAAAATGATAAACTTATTCGAGA

GGTTAAAGTGATTACCTTAAAATCTAAATTAGTTTCTGACTTCCGAAAAGATTTCCAATTCT

ATAAAGTACGTGAGATTAACAATTACCATCATGCCCATGATGCGTATCTAAATGCCGTCGTT

GGAACTGCTTTGATTAAGAAATATCCAAAACTTGAATCGGAGTTTGTCTATGGTGATTATAA
```

-continued

```
AGTTTATGATGTTCGTAAAATGATTGCTAAGTCTGAGCAAGAAATAGGCAAAGCAACCGCAA

AATATTTCTTTTACTCTAATATCATGAACTTCTTCAAAACAGAAATTACACTTGCAAATGGA

GAGATTCGCAAACGCCCTCTAATCGAAACTAATGGGGAAACTGGAGAAATTGTCTGGGATAA

AGGGCGAGATTTTGCCACAGTGCGCAAAGTATTGTCCATGCCCCAAGTCAATATTGTCAAGA

AAACAGAAGTACAGACAGGCGGATTCTCCAAGGAGTCAATTTTACCAAAAAGAAATTCGGAC

AAGCTTATTGCTCGTAAAAAAGACTGGGATCCAAAAAAATATGGTGGTTTTGATAGTCCAAC

GGTAGCTTATTCAGTCCTAGTGGTTGCTAAGGTGGAAAAAGGGAAATCGAAGAAGTTAAAAT

CCGTTAAAGAGTTACTAGGGATCACAATTATGGAAAGAAGTTCCTTTGAAAAAAATCCGATT

GACTTTTTAGAAGCTAAAGGATATAAGGAAGTTAAAAAAGACTTAATCATTAAACTACCTAA

ATATAGTCTTTTTGAGTTAGAAAACGGTCGTAAACGGATGCTGGCTAGTGCCGGAGAATTAC

AAAAAGGAAATGAGCTGGCTCTGCCAAGCAAATATGTGAATTTTTTATATTTAGCTAGTCAT

TATGAAAAGTTGAAGGGTAGTCCAGAAGATAACGAACAAAAACAATTGTTTGTGGAGCAGCA

TAAGCATTATTTAGATGAGATTATTGAGCAAATCAGTGAATTTTCTAAGCGTGTTATTTTAG

CAGATGCCAATTTAGATAAAGTTCTTAGTGCATATAACAAACATAGAGACAAACCAATACGT

GAACAAGCAGAAAATATTATTCATTTATTTACGTTGACGAATCTTGGAGCTCCCGCTGCTTT

TAAATATTTTGATACAACAATTGATCGTAAACGATATACGTCTACAAAAGAAGTTTTAGATG

CCACTCTTATCCATCAATCCATCACTGGTCTTTATGAAACACGCATTGATTTGAGTCAGCTA

GGAGGTGACTGA
```

(SEQ ID NO: 2)
MDKK<u>YSIGLDIGTNSVGWAVITDDYKVPSKKFKVLGNTDRHSIKKNLIGALLFGSGETA</u>EAT

RLKRTARRRYTRRKNRICYLQEIFSNEMAKVDDSFFHRLEESFLVEEDKKHERHPIFGNIVD

EVAYHEKYPTIYHLRKKLADSTDKADLRLIYLALAHMIKFRGHFLIEGDLNPDNSDVDKLFI

QLVQIYNQLFEENPINASRVDAKAILSARLSKSRRLENLIAQLPGEKRNGLFGNLIALSLGL

TPNFKSNFDLAEDAKLQLSKDTYDDDLDNLLAQIGDQYADLFLAAKNLSDAILLSDILRVNS

EITKAPLSASMIKRYDEHHQDLTLLKALVRQQLPEKYKEIFFDQSKNGYAGYIDGGASQEEF

YKFIKPILEKMDGTEELLVKLNREDLLRKQRTFDNGSIPHQIHLGELHAILRRQEDFYPFLK

DNREKIEKILTFRIPYYVGPLARGNSRFAWMTRKSEETITPWNFEEVVDKGASAQSFIERMT

NFDKNLPNEKVLPKHSLLYEYFTVYNELTKVKYVTEGMRKPAFLSGEQKKAIVDLLEKTNRK

VTVKQLKEDYFKKIECFDSVEISGVEDRFNASLGAYHDLLKIIKDKDELDNEENEDILEDIV

LTLTLFEDRGMIEERLKTYAHLFDDKVMKQLKRRRYTGWGRLSRKLINGIRDKQSGKTILDE

LKSDGFANRNFMQLIHDDSLTFKEDIQKAQVSGQG<u>HSLHEQIANLAGSPAIKKGILQTVKIV

DELVKVMGHKPENIVIEMARE</u>NQTTQKG<u>QKNSRERMKRIEEGIKELGSQILKEHPVENTQLQ

NEKLYLYYLQNGRDMYVDQELDINRLSDYDVDHIVPQSFIKDDSIDNKVLTRSDKNRGKSDN

VPSEEVVKKMKNYWRQLLNAKLITQRKFDNLTKAERG</u>GLSELDKAGFIKRQLVETRQITKHV

AQILDSRMNTKYDENDKLIREVKVITLKSKLVSDERKDFQFYKVREINNYHHAHDAYLNAVV

GTALIKKYPKLESEFVYGDYKVYDVRKMIAKSEQEIGKATAKYFFYSNIMNFFKTEITLANG

EIRKRPLIETNGETGEIVWDKGRDFATVRKVLSMPQVNIVKKTEVQTGGFSKESILPKRNSD

KLIARKKDWDPKKYGGFDSPTVAYSVLVVAKVEKGKSKKLKSVKELLGITIMERSSFEKNPI

DFLEAKGYKEVKKDLIIKLPKYSLFELENGRKRMLASAGELQKGNELALPSKYVNFLYLASH

-continued

YEKLKGSPEDNEQKQLFVEQHKHYLDEIIEQISEFSKRVILADANLDKVLSAYNKHRDKPIR

EQAENIIHLFTLTNLGAPAAFKYFDTTIDRKRYTSTKEVLDATLIHQSITGLYETRIDLSQL

GGD (single underline: HINH domain; double underline: RuvC domain)

In some embodiments, wild type Cas9 corresponds to, or comprises the following nucleotide and/or amino acid sequences:

(SEQ ID NO: 13)
ATGGATAAAAAGTATTCTATTGGTTTAGACATCGGCACTAATTCCGTTGGATGGGCTGTCAT

AACCGATGAATACAAAGTACCTTCAAAGAAATTTAAGGTGTTGGGGAACACAGACCGTCATT

CGATTAAAAAGAATCTTATCGGTGCCCTCCTATTCGATAGTGGCGAAACGGCAGAGGCGACT

CGCCTGAAACGAACCGCTCGGAGAAGGTATACACGTCGCAAGAACCGAATATGTTACTTACA

AGAAATTTTTAGCAATGAGATGGCCAAAGTTGACGATTCTTTCTTTCACCGTTTGGAAGAGT

CCTTCCTTGTCGAAGAGGACAAGAAACATGAACGGCACCCCATCTTTGGAAACATAGTAGAT

GAGGTGGCATATCATGAAAAGTACCCAACGATTTATCACCTCAGAAAAAAGCTAGTTGACTC

AACTGATAAAGCGGACCTGAGGTTAATCTACTTGGCTCTTGCCCATATGATAAAGTTCCGTG

GGCACTTTCTCATTGAGGGTGATCTAAATCCGGACAACTCGGATGTCGACAAACTGTTCATC

CAGTTAGTACAAACCTATAATCAGTTGTTTGAAGAGAACCCTATAAATGCAAGTGGCGTGGA

TGCGAAGGCTATTCTTAGCGCCCGCCTCTCTAAATCCCGACGGCTAGAAAACCTGATCGCAC

AATTACCCGGAGAGAAGAAAAATGGGTTGTTCGGTAACCTTATAGCGCTCTCACTAGGCCTG

ACACCAAATTTTAAGTCGAACTTCGACTTAGCTGAAGATGCCAAATTGCAGCTTAGTAAGGA

CACGTACGATGACGATCTCGACAATCTACTGGCACAAATTGGAGATCAGTATGCGGACTTAT

TTTTGGCTGCCAAAAACCTTAGCGATGCAATCCTCCTATCTGACATACTGAGAGTTAATACT

GAGATTACCAAGGCGCCGTTATCCGCTTCAATGATCAAAAGGTACGATGAACATCACCAAGA

CTTGACACTTCTCAAGGCCCTAGTCCGTCAGCAACTGCCTGAGAAATATAAGGAAATATTCT

TTGATCAGTCGAAAAACGGGTACGCAGGTTATATTGACGGCGGAGCGAGTCAAGAGGAATTC

TACAAGTTTATCAAACCCATATTAGAGAAGATGGATGGGACGGAAGAGTTGCTTGTAAAACT

CAATCGCGAAGATCTACTGCGAAAGCAGCGGACTTTCGACAACGGTAGCATTCCACATCAAA

TCCACTTAGGCGAATTGCATGCTATACTTAGAAGGCAGGAGGATTTTTATCCGTTCCTCAAA

GACAATCGTGAAAAGATTGAGAAAATCCTAACCTTTCGCATACCTTACTATGTGGGACCCCT

GGCCCGAGGGAACTCTCGGTTCGCATGGATGACAAGAAAGTCCGAAGAAACGATTACTCCAT

GGAATTTTGAGGAAGTTGTCGATAAAGGTGCGTCAGCTCAATCGTTCATCGAGAGGATGACC

AACTTTGACAAGAATTTACCGAACGAAAAAGTATTGCCTAAGCACAGTTTACTTTACGAGTA

TTTCACAGTGTACAATGAACTCACGAAAGTTAAGTATGTCACTGAGGGCATGCGTAAACCCG

CCTTTCTAAGCGGAGAACAGAAGAAAGCAATAGTAGATCTGTTATTCAAGACCAACCGCAAA

GTGACAGTTAAGCAATTGAAAGAGGACTACTTTAAGAAAATTGAATGCTTCGATTCTGTCGA

GATCTCCGGGGTAGAAGATCGATTTAATGCGTCACTTGGTACGTATCATGACCTCCTAAAGA

TAATTAAAGATAAGGACTTCCTGGATAACGAAGAGAATGAAGATATCTTAGAAGATATAGTG

TTGACTCTTACCCTCTTTGAAGATCGGGAAATGATTGAGGAAAGACTAAAAACATACGCTCA

CCTGTTCGACGATAAGGTTATGAAACAGTTAAAGAGGCGTCGCTATACGGGCTGGGGACGAT

-continued

```
TGTCGCGGAAACTTATCAACGGGATAAGAGACAAGCAAAGTGGTAAAACTATTCTCGATTTT
CTAAAGAGCGACGGCTTCGCCAATAGGAACTTTATGCAGCTGATCCATGATGACTCTTTAAC
CTTCAAAGAGGATATACAAAAGGCACAGGTTTCCGGACAAGGGGACTCATTGCACGAACATA
TTGCGAATCTTGCTGGTTCGCCAGCCATCAAAAAGGGCATACTCCAGACAGTCAAAGTAGTG
GATGAGCTAGTTAAGGTCATGGGACGTCACAAACCGGAAAACATTGTAATCGAGATGGCACG
CGAAAATCAAACGACTCAGAAGGGGCAAAAAAACAGTCGAGAGCGGATGAAGAGAATAGAAG
AGGGTATTAAGAACTGGGCAGCCAGATCTTAAAGGAGCATCCTGTGGAAAATACCCAATTG
CAGAACGAGAAACTTTACCTCTATTACCTACAAAATGGAAGGGACATGTATGTTGATCAGGA
ACTGGACATAAACCGTTTATCTGATTACGACGTCGATCACATTGTACCCCAATCCTTTTTGA
AGGACGATTCAATCGACAATAAAGTGCTTACACGCTCGGATAAGAACCGAGGGAAAAGTGAC
AATGTTCCAAGCGAGGAAGTCGTAAAGAAAATGAAGAACTATTGGCGGCAGCTCCTAAATGC
GAAACTGATAACGCAAAGAAAGTTCGATAACTTAACTAAAGCTGAGAGGGGGCTTGTCTG
AACTTGACAAGGCCGGATTTATTAAACGTCAGCTCGTGGAAACCCGCCAAATCACAAAGCAT
GTTGCACAGATACTAGATTCCCGAATGAATACGAAATACGACGAGAACGATAAGCTGATTCG
GGAAGTCAAAGTAATCACTTTAAAGTCAAAATTGGTGTCGGACTTCAGAAAGGATTTTCAAT
TCTATAAAGTTAGGGAGATAAATAACTACCACCATGCGCACGACGCTTATCTTAATGCCGTC
GTAGGGACCGCACTCATTAAGAAATACCCGAAGCTAGAAAGTGAGTTTGTGTATGGTGATTA
CAAAGTTTATGACGTCCGTAAGATGATCGCGAAAAGCGAACAGGAGATAGGCAAGGCTACAG
CCAAATACTTCTTTTATTCTAACATTATGAATTTCTTTAAGACGGAAATCACTCTGGCAAAC
GGAGAGATACGCAAACGACCTTTAATTGAAACCAATGGGGAGACAGGTGAAATCGTATGGGA
TAAGGGCCGGGACTTCGCGACGGTGAGAAAAGTTTTGTCCATGCCCCAAGTCAACATAGTAA
AGAAAACTGAGGTGCAGACCGGAGGGTTTTCAAAGGAATCGATTCTTCCAAAAAGGAATAGT
GATAAGCTCATCGCTCGTAAAAAGGACTGGGACCCGAAAAAGTACGGTGGCTTCGATAGCCC
TACAGTTGCCTATTCTGTCCTAGTAGTGGCAAAAGTTGAGAAGGGAAAATCCAAGAAACTGA
AGTCAGTCAAAGAATTATTGGGGATAACGATTATGGAGCGCTCGTCTTTTGAAAAGAACCCC
ATCGACTTCCTTGAGGCGAAAGGTTACAAGGAAGTAAAAAAGGATCTCATAATTAAACTACC
AAAGTATAGTCTGTTTGAGTTAGAAAATGGCCGAAAACGGATGTTGGCTAGCGCCGGAGAGC
TTCAAAAGGGGAACGAACTCGCACTACCGTCTAAATACGTGAATTTCCTGTATTTAGCGTCC
CATTACGAGAAGTTGAAAGGTTCACCTGAAGATAACGAACAGAAGCAACTTTTTGTTGAGCA
GCACAAACATTATCTCGACGAAATCATAGAGCAAATTTCGGAATTCAGTAAGAGAGTCATCC
TAGCTGATGCCAATCTGGACAAAGTATTAAGCGCATACAACAAGCACAGGGATAAACCCATA
CGTGAGCAGGCGGAAAATATTATCCATTTGTTTACTCTTACCAACCTCGGCGCTCCAGCCGC
ATTCAAGTATTTTGACACAACGATAGATCGCAAACGATACACTTCTACCAAGGAGGTGCTAG
ACGCGACACTGATTCACCAATCCATCACGGGATTATATGAAACTCGGATAGATTTGTCACAG
CTTGGGGGTGACGGATCCCCCAAGAAGAAGAGGAAAGTCTCGAGCGACTACAAAGACCATGA
CGGTGATTATAAAGATCATGACATCGATTACAAGGATGACGATGACAAGGCTGCAGGA
```

(SEQ ID NO: 14)
MDKK<u>YSIGLAIGTNSVGWAVITDEYKVPSKKFKVLGNTDRHSIKKNLIGALLEDSGETA</u>EAT
RLKRTARRRYTRRKNRICYLQEIFSNEMAKVDDSFFHRLEESFLVEEDKKHERHPIFGNIVD
EVAYHEKYPTIYHLRKKLVDSTDKADLRLIYLALAHMIKFRGHFLIEGDLNPDNSDVDKLFI
QLVQTYNQLFEENPINASGVDAKAILSARLSKSRRLENLIAQLPGEKKNGLFGNLIALSLGL

-continued

```
TPNFKSNFDLAEDAKLQLSKDTYDDDLDNLLAQIGDQYADLFLAAKNLSDAILLSDILRVNT

EITKAPLSASMIKRYDEHHQDLTLLKALVRQQLPEKYKEIFFDQSKNGYAGYIDGGASQEEF

YKFIKPILEKMDGTEELLVKLNREDLLRKQRTFDNGSIPHQIHLGELHAILRRQEDFYPFLK

DNREKIEKILTFRIPYYVGPLARGNSRFAWMTRKSEETITPWNFEEVVDKGASAQSFIERMT

NFDKNLPNEKVLPKHSLLYEYFTVYNELTKVKYVTEGMRKPAFLSGEQKKAIVDLLEKTNRK

VTVKQLKEDYFKKIECFDSVEISGVEDRENASLGTYHDLLKIIKDKDELDNEENEDILEDIV

LTLTLFEDREMIEERLKTYAHLFDDKVMKQLKRRRYTGWGRLSRKLINGIRDKQSGKTILDE

LKSDGFANRNFMQLIHDDSLTFKEDIQKAQVSGQG<u>DSLHEHIANLAGSPAIKKGILQTVKVV

DELVKVMGRHKPENIVIEMAR</u>ENQTTQKGQKNSRERMKRIEEGIKELGSQILKEHPVENTQL

QNEKLYLYYLQNGRDMYVDQELDINRLSDYDVDHIVPQSFLKDDSIDNKVLTRSDKNRGKSD

NVPSEEVVKKMKNYWRQLLNAKLITQRKEDNLTKAERG<u>GLSELDKAGFIKRQLVETRQITKH

VAQILDSRMNTKYDENDKLIREVKVITLKSKLVSDERKDFQFYKVREINNYHHAHDAYLNAV

VGTALIKKYPKLESEFVYGDYKVYDVRKMIAKSEQEIGKATAKYFFYSNIMNFFKTEITLAN

GEIRKRPLIETNGETGEIVWDKGRDFATVRKVLSMPQVNIVKKTEVQ</u>TGGFSKESILPKRNS

DKLIARKKDWDPKKYGGFDSPTVAYSVLVVAKVEKGKSKKLKSVKELLGITIMERSSFEKNP

IDFLEAKGYKEVKKDLIIKLPKYSLFELENGRKRMLASAGELQKGNELALPSKYVNFLYLAS

HYEKLKGSPEDNEQKQLFVEQHKHYLDEIIEQISEFSKRVILADANLDKVLSAYNKHRDKPI

REQAENIIHLFTLTNLGAPAAFKYFDTTIDRKRYTSTKEVLDATLIHQSITGLYETRIDLSQ

LGGD
```
(single underline: HNH domain; double underline: RuvC domain)

In some embodiments, wild type Cas9 corresponds to Cas9 from *Streptococcus pyogenes* (NCBI Reference Sequence: NC_002737.2 (nucleotide sequence as follows); and Uniprot Reference Sequence: Q99ZW2 (amino acid sequence as follows).

(SEQ ID NO: 15)
```
ATGGATAAGAAATACTCAATAGGCTTAGATATCGGCACAAATAGCGTCGGATGGGCGGTGAT

CACTGATGAATATAAGGTTCCGTCTAAAAAGTTCAAGGTTCTGGGAAATACAGACCGCCACA

GTATCAAAAAAAATCTTATAGGGGCTCTTTTATTTGACAGTGGAGAGACAGCGGAAGCGACT

CGTCTCAAACGGACAGCTCGTAGAAGGTATACACGTCGGAAGAATCGTATTTGTTATCTACA

GGAGATTTTTTCAAATGAGATGGCGAAAGTAGATGATAGTTTCTTTCATCGACTTGAAGAGT

CTTTTTTGGTGGAAGAAGACAAGAAGCATGAACGTCATCCTATTTTTGGAAATATAGTAGAT

GAAGTTGCTTATCATGAGAAATATCCAACTATCTATCATCTGCGAAAAAAATTGGTAGATTC

TACTGATAAAGCGGATTTGCGCTTAATCTATTTGGCCTTAGCGCATATGATTAAGTTTCGTG

GTCATTTTTTGATTGAGGGAGATTTAAATCCTGATAATAGTGATGTGGACAAACTATTTATC

CAGTTGGTACAAACCTACAATCAATTATTTGAAGAAAACCCTATTAACGCAAGTGGAGTAGA

TGCTAAAGCGATTCTTTCTGCACGATTGAGTAAATCAAGACGATTAGAAAATCTCATTGCTC

AGCTCCCCGGTGAGAAGAAAAATGGCTTATTTGGGAATCTCATTGCTTTGTCATTGGGTTTG

ACCCCTAATTTTAAATCAAATTTTGATTTGGCAGAAGATGCTAAATTACAGCTTTCAAAAGA

TACTTACGATGATGATTTAGATAATTTATTGGCGCAAATTGGAGATCAATATGCTGATTTGT

TTTTGGCAGCTAAGAATTTATCAGATGCTATTTTACTTTCAGATATCCTAAGAGTAAATACT

GAAATAACTAAGGCTCCCCTATCAGCTTCAATGATTAAACGCTACGATGAACATCATCAAGA
```

-continued

```
CTTGACTCTTTTAAAAGCTTTAGTTCGACAACAACTTCCAGAAAAGTATAAAGAAATCTTTT

TTGATCAATCAAAAAACGGATATGCAGGTTATATTGATGGGGAGCTAGCCAAGAAGAATTT

TATAAATTTATCAAACCAATTTTAGAAAAAATGGATGGTACTGAGGAATTATTGGTGAAACT

AAATCGTGAAGATTTGCTGCGCAAGCAACGGACCTTTGACAACGGCTCTATTCCCCATCAAA

TTCACTTGGGTGAGCTGCATGCTATTTTGAGAAGACAAGAAGACTTTTATCCATTTTTAAAA

GACAATCGTGAGAAGATTGAAAAAATCTTGACTTTTCGAATTCCTTATTATGTTGGTCCATT

GGCGCGTGGCAATAGTCGTTTTGCATGGATGACTCGGAAGTCTGAAGAAACAATTACCCCAT

GGAATTTTGAAGAAGTTGTCGATAAAGGTGCTTCAGCTCAATCATTTATTGAACGCATGACA

AACTTTGATAAAAATCTTCCAAATGAAAAGTACTACCAAAACATAGTTTGCTTTATGAGTA

TTTTACGGTTTATAACGAATTGACAAAGGTCAAATATGTTACTGAAGGAATGCGAAAACCAG

CATTTCTTTCAGGTGAACAGAAGAAAGCCATTGTTGATTTACTCTTCAAAACAAATCGAAAA

GTAACCGTTAAGCAATTAAAAGAAGATTATTTCAAAAAAATAGAATGTTTTGATAGTGTTGA

AATTTCAGGAGTTGAAGATAGATTTAATGCTTCATTAGGTACCTACCATGATTTGCTAAAAA

TTATTAAAGATAAAGATTTTTTGGATAATGAAGAAATGAAGATATCTTAGAGGATATTGTT

TTAACATTGACCTTATTTGAAGATAGGGAGATGATTGAGGAAAGACTTAAAACATATGCTCA

CCTCTTTGATGATAAGGTGATGAAACAGCTTAAACGTCGCCGTTATACTGGTTGGGGACGTT

TGTCTCGAAAATTGATTAATGGTATTAGGGATAAGCAATCTGGCAAAACAATATTAGATTTT

TTGAAATCAGATGGTTTTGCCAATCGCAATTTTATGCAGCTGATCCATGATGATAGTTTGAC

ATTTAAAGAAGACATTCAAAAAGCACAAGTGTCTGGACAAGGCGATAGTTTACATGAACATA

TTGCAAATTTAGCTGGTAGCCCTGCTATTAAAAAAGGTATTTTACAGACTGTAAAAGTTGTT

GATGAATTGGTCAAAGTAATGGGGCGGCATAAGCCAGAAAATATCGTTATTGAAATGGCACG

TGAAAATCAGACAACTCAAAAGGGCCAGAAAAATTCGCGAGAGCGTATGAAACGAATCGAAG

AAGGTATCAAAGAATTAGGAAGTCAGATTCTTAAAGAGCATCCTGTTGAAAATACTCAATTG

CAAAATGAAAAGCTCTATCTCTATTATCTCCAAAATGGAAGAGACATGTATGTGGACCAAGA

ATTAGATATTAATCGTTTAAGTGATTATGATGTCGATCACATTGTTCCACAAAGTTTCCTTA

AAGACGATTCAATAGACAATAAGGTCTTAACGCGTTCTGATAAAAATCGTGGTAAATCGGAT

AACGTTCCAAGTGAAGAAGTAGTCAAAAAGATGAAAAACTATTGGAGACAACTTCTAAACGC

CAAGTTAATCACTCAACGTAAGTTTGATAATTTAACGAAAGCTGAACGTGGAGGTTTGAGTG

AACTTGATAAAGCTGGTTTTATCAAACGCCAATTGGTTGAAACTCGCCAAATCACTAAGCAT

GTGGCACAAATTTTGGATAGTCGCATGAATACTAAATACGATGAAAATGATAAACTTATTCG

AGAGGTTAAAGTGATTACCTTAAAATCTAAATTAGTTTCTGACTTCCGAAAAGATTTCCAAT

TCTATAAAGTACGTGAGATTAACAATTACCATCATGCCCATGATGCGTATCTAAATGCCGTC

GTTGGAACTGCTTTGATTAAGAAATATCCAAAACTTGAATCGGAGTTTGTCTATGGTGATTA

TAAAGTTTATGATGTTCGTAAAATGATTGCTAAGTCTGAGCAAGAAATAGGCAAAGCAACCG

CAAAATATTTCTTTTACTCTAATATCATGAACTTCTTCAAAACAGAAATTACACTTGCAAAT

GGAGAGATTCGCAAACGCCCTCTAATCGAAACTAATGGGGAAACTGGAGAAATTGTCTGGGA

TAAAGGGCGAGATTTTGCCACAGTGCGCAAAGTATTGTCCATGCCCCAAGTCAATATTGTCA

AGAAAACAGAAGTACAGACAGGCGGATTCTCCAAGGAGTCAATTTTACCAAAAAGAAATTCG

GACAAGCTTATTGCTCGTAAAAAGACTGGGATCCAAAAAAATATGGTGGTTTTGATAGTCC

AACGGTAGCTTATTCAGTCCTAGTGGTTGCTAAGGTGGAAAAAGGGAAATCGAAGAAGTTAA

AATCCGTTAAAGAGTTACTAGGGATCACAATTATGGAAAGAAGTTCCTTTGAAAAAAATCCG
```

-continued

```
ATTGACTTTTTAGAAGCTAAAGGATATAAGGAAGTTAAAAAAGACTTAATCATTAAACTACC

TAAATATAGTCTTTTTGAGTTAGAAAACGGTCGTAAACGGATGCTGGCTAGTGCCGGAGAAT

TACAAAAAGGAAATGAGCTGGCTCTGCCAAGCAAATATGTGAATTTTTTATATTTAGCTAGT

CATTATGAAAAGTTGAAGGGTAGTCCAGAAGATAACGAACAAAAACAATTGTTTGTGGAGCA

GCATAAGCATTATTTAGATGAGATTATTGAGCAAATCAGTGAATTTTCTAAGCGTGTTATTT

TAGCAGATGCCAATTTAGATAAAGTTCTTAGTGCATATAACAAACATAGAGACAAACCAATA

CGTGAACAAGCAGAAAATATTATTCATTTATTTACGTTGACGAATCTTGGAGCTCCCGCTGC

TTTTAAATATTTTGATACAACAATTGATCGTAAACGATATACGTCTACAAAAGAAGTTTTAG

ATGCCACTCTTATCCATCAATCCATCACTGGTCTTTATGAAACACGCATTGATTTGAGTCAG

CTAGGAGGTGACTGA
```

(SEQ ID NO: 16)
MDKK<u>YSIGLDIGTNSVGWAVITDEYKVPSKKFKVLGNTDRHSIKKNLIGALLFDSGETA</u>EAT

RLKRTARRRYTRRKNRICYLQEIFSNEMAKVDDSFFHRLEESFLVEEDKKHERHPIFGNIVD

EVAYHEKYPTIYHLRKKLVDSTDKADLRLIYLALAHMIKERGHFLIEGDLNPDNSDVDKLFI

QLVQTYNQLFEENPINASGVDAKAILSARLSKSRRLENLIAQLPGEKKNGLFGNLIALSLGL

TPNFKSNFDLAEDAKLQLSKDTYDDDLDNLLAQIGDQYADLFLAAKNLSDAILLSDILRVNT

EITKAPLSASMIKRYDEHHQDLTLLKALVRQQLPEKYKEIFFDQSKNGYAGYIDGGASQEEF

YKFIKPILEKMDGTEELLVKLNREDLLRKQRTFDNGSIPHQIHLGELHAILRRQEDFYPFLK

DNREKIEKILTFRIPYYVGPLARGNSRFAWMTRKSEETITPWNFEEVVDKGASAQSFIERMT

NFDKNLPNEKVLPKHSLLYEYFTVYNELTKVKYVTEGMRKPAFLSGEQKKAIVDLLEKTNRK

VTVKQLKEDYFKKIECFDSVEISGVEDRENASLGTYHDLLKIIKDKDELDNEENEDILEDIV

LTLTLFEDREMIEERLKTYAHLEDDKVMKQLKRRRYTGWGRLSRKLINGIRDKQSGKTILDE

LKSDGFANRNFMQLIHDDSLTFKEDIQKAQVSGQG<u>DSLHEHIANLAGSPAIKKGILQTVKVV

DELVKVMGRHKPENIVIEMAR</u>ENQTTQKGQKNSRERMKRIEEGIKELGSQILKEHPVENTQL

QNEKLYLYYLQNGRDMYVDQELDINRLSDYDVDHIVPQSFLKDDSIDNKVLTRSDKNRGKSD

NVPSEEVVKKMKNYWRQLLNAKLITQRKFDNLTKAERG<u>GLSELDKAGFIKRQLVETRQITKH

VAQILDSRMNTKYDENDKLIREVKVITLKSKLVSDERKDFQFYKVREINNYHHAHDAYLNAV

VGTALIKKYPKLESEFVYGDYKVYDVRKMIAKSEQEIGKATAKYFFYSNIMNFFKTEITLAN

GEIRKRPLIETNGETGEIVWDKGRDFATVRKVLSMPQVNIVKKTEVQT</u>GGFSKESILPKRNS

DKLIARKKDWDPKKYGGFDSPTVAYSVLVVAKVEKGKSKKLKSVKELLGITIMERSSFEKNP

IDFLEAKGYKEVKKDLIIKLPKYSLFELENGRKRMLASAGELQKGNELALPSKYVNFLYLAS

HYEKLKGSPEDNEQKQLFVEQHKHYLDEIIEQISEFSKRVILADANLDKVLSAYNKHRDKPI

REQAENIIHLFTLTNLGAPAAFKYFDTTIDRKRYTSTKEVLDATLIHQSITGLYETRIDLSQ

LGGD (single underline: HNH domain; double underline: RuvC domain)

In some embodiments, Cas9 refers to Cas9 from: *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref: NC_021846.1); *Streptococcus iniae* (NCBI Ref: NC_021314.1); *Belliella baltica* (NCBI Ref: NC_018010.1); *Psychroflexus torquisI* (NCBI Ref: NC_018721.1); *Streptococcus thermophilus* (NCBI Ref: YP_820832.1), *Listeria innocua* (NCBI Ref: NP_472073.1), *Campylobacter jejuni* (NCBI Ref: YP_002344900.1) or *Neisseria. meningitidis* (NCBI Ref: YP_002342100.1) or to a Cas9 from any other organism.

In some embodiments, dCas9 corresponds to, or comprises in part or in whole, a Cas9 amino acid sequence having one or more mutations that inactivate the Cas9 nuclease activity. For example, in some embodiments, a dCas9 domain comprises D10A and an H840A mutation or corresponding mutations in another Cas9. In some embodiments, the dCas9 comprises the amino acid sequence of dCas9 (D10A and H840A):

In some embodiments, Cas9 fusion proteins as provided herein comprise the full-length amino acid sequence of a Cas9 protein, e.g., one of the Cas9 sequences provided

```
                                                       (SEQ ID NO: 17)
MDKKYSIGLAIGTNSVGWAVITDEYKVPSKKFKVLGNTDRHSIKKNLIGALLFDSGETAEAT

RLKRTARRRYTRRKNRICYLQEIFSNEMAKVDDSFFHRLEESFLVEEDKKHERHPIFGNIVD

EVAYHEKYPTIYHLRKKLVDSTDKADLRLIYLALAHMIKERGHFLIEGDLNPDNSDVDKLFI

QLVQTYNQLFEENPINASGVDAKAILSARLSKSRRLENLIAQLPGEKKNGLFGNLIALSLGL

TPNFKSNEDLAEDAKLQLSKDTYDDDLDNLLAQIGDQYADLFLAAKNLSDAILLSDILRVNT

EITKAPLSASMIKRYDEHHQDLTLLKALVRQQLPEKYKEIFFDQSKNGYAGYIDGGASQEEF

YKFIKPILEKMDGTEELLVKLNREDLLRKQRTFDNGSIPHQIHLGELHAILRRQEDFYPFLK

DNREKIEKILTFRIPYYVGPLARGNSRFAWMTRKSEETITPWNFEEVVDKGASAQSFIERMT

NFDKNLPNEKVLPKHSLLYEYFTVYNELTKVKYVTEGMRKPAFLSGEQKKAIVDLLEKTNRK

VTVKQLKEDYFKKIECFDSVEISGVEDRFNASLGTYHDLLKIIKDKDELDNEENEDILEDIV

LTLTLFEDREMIEERLKTYAHLFDDKVMKQLKRRRYTGWGRLSRKLINGIRDKQSGKTILDE

LKSDGFANRNFMQLIHDDSLTFKEDIQKAQVSGQGDSLHEHIANLAGSPAIKKGILQTVKVV

DELVKVMGRHKPENIVIEMARENQTTQKGQKNSRERMKRIEEGIKELGSQILKEHPVENTQL

QNEKLYLYYLQNGRDMYVDQELDINRLSDYDVDAIVPQSFLKDDSIDNKVLTRSDKNRGKSD

NVPSEEVVKKMKNYWRQLLNAKLITQRKEDNLTKAERGGLSELDKAGFIKRQLVETRQITKH

VAQILDSRMNTKYDENDKLIREVKVITLKSKLVSDERKDFQFYKVREINNYHHAHDAYLNAV

VGTALIKKYPKLESEFVYGDYKVYDVRKMIAKSEQEIGKATAKYFFYSNIMNFFKTEITLAN

GEIRKRPLIETNGETGEIVWDKGRDFATVRKVLSMPQVNIVKKTEVQTGGFSKESILPKRNS

DKLIARKKDWDPKKYGGFDSPTVAYSVLVVAKVEKGKSKKLKSVKELLGITIMERSSFEKNP

IDFLEAKGYKEVKKDLIIKLPKYSLFELENGRKRMLASAGELQKGNELALPSKYVNFLYLAS

HYEKLKGSPEDNEQKQLFVEQHKHYLDEIIEQISEFSKRVILADANLDKVLSAYNKHRDKPI

REQAENIIHLFTLTNLGAPAAFKYFDTTIDRKRYTSTKEVLDATLIHQSITGLYETRIDLSQ

LGGD
(single underline: HNH domain; double underline: RuvC domain).
```

In some embodiments, the Cas9 domain comprises a D10A mutation, while the residue at position 840 remains a histidine in the amino acid sequence provided above, or at corresponding positions in any of the amino acid sequences provided herein.

In other embodiments, dCas9 variants having mutations other than D10A and H840A are provided, which, e.g., result in nuclease inactivated Cas9 (dCas9). Such mutations, by way of example, include other amino acid substitutions at D10 and H840, or other substitutions within the nuclease domains of Cas9 (e.g., substitutions in the HNH nuclease subdomain and/or the RuvCI subdomain). In some embodiments, variants or homologues of dCas9 are provided which are at least about 70% identical, at least about 80% identical, at least about 90% identical, at least about 95% identical, at least about 98% identical, at least about 99% identical, at least about 99.5% identical, or at least about 99.9% identical. In some embodiments, variants of dCas9 are provided having amino acid sequences which are shorter, or longer, by about 5 amino acids, by about 10 amino acids, by about 15 amino acids, by about 20 amino acids, by about 25 amino acids, by about 30 amino acids, by about 40 amino acids, by about 50 amino acids, by about 75 amino acids, by about 100 amino acids or more.

herein. In other embodiments, however, fusion proteins as provided herein do not comprise a full-length Cas9 sequence, but only one or more fragments thereof.

Exemplary amino acid sequences of suitable Cas9 domains and Cas9 fragments are provided herein, and additional suitable sequences of Cas9 domains and fragments will be apparent to those of skill in the art.

In some embodiments, Cas9 refers to Cas9 from: *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref: NC_021846.1); *Streptococcus iniae* (NCBI Ref: NC_021314.1); *Belliella baltica* (NCBI Ref: NC_018010.1); *Psychroflexus torquisI* (NCBI Ref: NC_018721.1); *Streptococcus thermophilus* (NCBI Ref: YP_820832.1); *Listeria innocua* (NCBI Ref: NP_472073.1); *Campylobacter jejuni* (NCBI Ref: YP_002344900.1); or *Neisseria. meningitidis* (NCBI Ref: YP_002342100.1).

It should be appreciated that additional Cas9 proteins (e.g., a nuclease dead Cas9 (dCas9), a Cas9 nickase (nCas9), or a nuclease active Cas9), including variants and homologs thereof, are within the scope of this disclosure. Exemplary Cas9 proteins include, without limitation, those provided below. In some embodiments, the Cas9 protein is a nuclease dead Cas9 (dCas9). In some embodiments, the Cas9 protein is a Cas9 nickase (nCas9). In some embodiments, the Cas9 protein is a nuclease active Cas9.

```
Exemplary catalytically inactive Cas9 (dCas9):
                                                 (SEQ ID NO: 18)
DKKYSIGLAIGTNSVGWAVITDEYKVPSKKFKVLGNTDRHSIKKNLIGALLFDSGETA

EATRLKRTARRRYTRRKNRICYLQEIFSNEMAKVDDSFFHRLEESFLVEEDKKHERH

PIFGNIVDEVAYHEKYPTIYHLRKKLVDSTDKADLRLIYLALAHMIKFRGHFLIEGDL

NPDNSDVDKLFIQLVQTYNQLFEENPINASGVDAKAILSARLSKSRRLENLIAQLPGE

KKNGLFGNLIALSLGLTPNFKSNFDLAEDAKLQLSKDTYDDDLDNLLAQIGDQYADL

FLAAKNLSDAILLSDILRVNTEITKAPLSASMIKRYDEHHQDLTLLKALVRQQLPEKY

KEIFFDQSKNGYAGYIDGGASQEEFYKFIKPILEKMDGTEELLVKLNREDLLRKQRTF

DNGSIPHQIHLGELHAILRRQEDFYPFLKDNREKIEKILTFRIPYYVGPLARGNSRFAW

MTRKSEETITPWNFEEVVDKGASAQSFIERMTNFDKNLPNEKVLPKHSLLYEYFTVY

NELTKVKYVTEGMRKPAFLSGEQKKAIVDLLFKTNRKVTVKQLKEDYFKKIECFDS

VEISGVEDRFNASLGTYHDLLKIIKDKDFLDNEENEDILEDIVLTLTLFEDREMIEERL

KTYAHLFDDKVMKQLKRRRYTGWGRLSRKLINGIRDKQSGKTILDFLKSDGFANRN

FMQLIHDDSLTFKEDIQKAQVSGQGDSLHEHIANLAGSPAIKKGILQTVKVVDELVK

VMGRHKPENIVIEMARENQTTQKGQKNSRERMKRIEEGIKELGSQILKEHPVENTQL

QNEKLYLYYLQNGRDMYVDQELDINRLSDYDVDAIVPQSFLKDDSIDNKVLTRSDK

NRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKV

REINNYHHAHDAYLNAVVGTALIKKYPKLESEFVYGDYKVYDVRKMIAKSEQEIGK

ATAKYFFYSNIMNFFKTEITLANGEIRKRPLIETNGETGEIVWDKGRDFATVRKVLSM

PQVNIVKKTEVQTGGFSKESILPKRNSDKLIARKKDWDPKKYGGFDSPTVAYSVLVV

AKVEKGKSKKLKSVKELLGITIMERSSFEKNPIDFLEAKGYKEVKKDLIIKLPKYSLFE

LENGRKRMLASAGELQKGNELALPSKYVNFLYLASHYEKLKGSPEDNEQKQLFVEQ

HKHYLDEIIEQISEFSKRVILADANLDKVLSAYNKHRDKPIREQAENIIHLFTLTNLGA

PAAFKYFDTTIDRKRYTSTKEVLDATLIHQSITGLYETRIDLSQLGGD

Exemplary catalytically Cas9 nickase (nCas9):
                                                 (SEQ ID NO: 19)
DKKYSIGLAIGTNSVGWAVITDEYKVPSKKFKVLGNTDRHSIKKNLIGALLFDSGETA

EATRLKRTARRRYTRRKNRICYLQEIFSNEMAKVDDSFFHRLEESFLVEEDKKHERH

PIFGNIVDEVAYHEKYPTIYHLRKKLVDSTDKADLRLIYLALAHMIKFRGHFLIEGDL

NPDNSDVDKLFIQLVQTYNQLFEENPINASGVDAKAILSARLSKSRRLENLIAQLPGE

KKNGLFGNLIALSLGLTPNFKSNFDLAEDAKLQLSKDTYDDDLDNLLAQIGDQYADL

FLAAKNLSDAILLSDILRVNTEITKAPLSASMIKRYDEHHQDLTLLKALVRQQLPEKY

KEIFFDQSKNGYAGYIDGGASQEEFYKFIKPILEKMDGTEELLVKLNREDLLRKQRTF

DNGSIPHQIHLGELHAILRRQEDFYPFLKDNREKIEKILTFRIPYYVGPLARGNSRFAW

MTRKSEETITPWNFEEVVDKGASAQSFIERMTNFDKNLPNEKVLPKHSLLYEYFTVY

NELTKVKYVTEGMRKPAFLSGEQKKAIVDLLFKTNRKVTVKQLKEDYFKKIECFDS

VEISGVEDRFNASLGTYHDLLKIIKDKDFLDNEENEDILEDIVLTLTLFEDREMIEERL

KTYAHLFDDKVMKQLKRRRYTGWGRLSRKLINGIRDKQSGKTILDFLKSDGFANRN
```

-continued

```
FMQLIHDDSLTFKEDIQKAQVSGQGDSLHEHIANLAGSPAIKKGILQTVKVVDELVK

VMGRHKPENIVIEMARENQTTQKGQKNSRERMKRIEEGIKELGSQILKEHPVENTQL

QNEKLYLYYLQNGRDMYVDQELDINRLSDYDVDHIVPQSFLKDDSIDNKVLTRSDK

NRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKV

REINNYHHAHDAYLNAVVGTALIKKYPKLESEFVYGDYKVYDVRKMIAKSEQEIGK

ATAKYFFYSNIMNFFKTEITLANGEIRKRPLIETNGETGEIVWDKGRDFATVRKVLSM

PQVNIVKKTEVQTGGFSKESILPKRNSDKLIARKKDWDPKKYGGFDSPTVAYSVLVV

AKVEKGKSKKLKSVKELLGITIMERSSFEKNPIDFLEAKGYKEVKKDLIIKLPKYSLFE

LENGRKRMLASAGELQKGNELALPSKYVNFLYLASHYEKLKGSPEDNEQKQLFVEQ

HKHYLDEIIEQISEFSKRVILADANLDKVLSAYNKHRDKPIREQAENIIHLFTLTNLGA

PAAFKYFDTTIDRKRYTSTKEVLDATLIHQSITGLYETRIDLSQLGGD
```

Exemplary catalytically active Cas9:

(SEQ ID NO: 20)
```
DKKYSIGLDIGTNSVGWAVITDEYKVPSKKFKVLGNTDRHSIKKNLIGALLFDSGETA

EATRLKRTARRRYTRRKNRICYLQEIFSNEMAKVDDSFFHRLEESFLVEEDKKHERH

PIFGNIVDEVAYHEKYPTIYHLRKKLVDSTDKADLRLIYLALAHMIKFRGHFLIEGDL

NPDNSDVDKLFIQLVQTYNQLFEENPINASGVDAKAILSARLSKSRRLENLIAQLPGE

KKNGLFGNLIALSLGLTPNFKSNFDLAEDAKLQLSKDTYDDDLDNLLAQIGDQYADL

FLAAKNLSDAILLSDILRVNTEITKAPLSASMIKRYDEHHQDLTLLKALVRQQLPEKY

KEIFFDQSKNGYAGYIDGGASQEEFYKFIKPILEKMDGTEELLVKLNREDLLRKQRTF

DNGSIPHQIHLGELHAILRRQEDFYPFLKDNREKIEKILTFRIPYYVGPLARGNSRFAW

MTRKSEETITPWNFEEVVDKGASAQSFIERMTNFDKNLPNEKVLPKHSLLYEYFTVY

NELTKVKYVTEGMRKPAFLSGEQKKAIVDLLFKTNRKVTVKQLKEDYFKKIECFDS

VEISGVEDRFNASLGTYHDLLKIIKDKDFLDNEENEDILEDIVLTLTLFEDREMIEERL

KTYAHLFDDKVMKQLKRRRYTGWGRLSRKLINGIRDKQSGKTILDFLKSDGFANRN

FMQLIHDDSLTFKEDIQKAQVSGQGDSLHEHIANLAGSPAIKKGILQTVKVVDELVK

VMGRHKPENIVIEMARENQTTQKGQKNSRERMKRIEEGIKELGSQILKEHPVENTQL

QNEKLYLYYLQNGRDMYVDQELDINRLSDYDVDHIVPQSFLKDDSIDNKVLTRSDK

NRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKV

REINNYHHAHDAYLNAVVGTALIKKYPKLESEFVYGDYKVYDVRKMIAKSEQEIGK

ATAKYFFYSNIMNFFKTEITLANGEIRKRPLIETNGETGEIVWDKGRDFATVRKVLSM

PQVNIVKKTEVQTGGFSKESILPKRNSDKLIARKKDWDPKKYGGFDSPTVAYSVLVV

AKVEKGKSKKLKSVKELLGITIMERSSFEKNPIDFLEAKGYKEVKKDLIIKLPKYSLFE

LENGRKRMLASAGELQKGNELALPSKYVNFLYLASHYEKLKGSPEDNEQKQLFVEQ

HKHYLDEIIEQISEFSKRVILADANLDKVLSAYNKHRDKPIREQAENIIHLFTLTNLGA

PAAFKYFDTTIDRKRYTSTKEVLDATLIHQSITGLYETRIDLSQLGGD.
```

In some embodiments, Cas9 refers to a Cas9 from archaea (e.g. nanoarchaea), which constitute a domain and kingdom of single-celled prokaryotic microbes. In some embodiments, Cas protein refers to CasX or CasY, which have been described in, for example, Burstein et al., "New CRISPR-Cas systems from uncultivated microbes." Cell Res. 2017 Feb. 21. doi: 10.1038/cr.2017.21, the entire contents of which is hereby incorporated by reference. Using genome-resolved metagenomics, a number of CRISPR-Cas systems were identified, including the first reported Cas9 in the archaeal domain of life. This divergent Cas9 protein was found in little-studied nanoarchaea as part of an active CRISPR-Cas system. In bacteria, two previously unknown systems were discovered, CRISPR-CasX and CRISPR-CasY, which are among the most compact systems yet discovered. In some embodiments, Cas9 refers to CasX, or a variant of CasX. In some embodiments, Cas9 refers to a CasY, or a variant of CasY. It should be appreciated that other RNA-guided DNA binding proteins may be used as a nucleic acid programmable DNA binding protein (napDNAbp), and are within the scope of this disclosure.

In some embodiments, the napDNAbp is a Cas9 domain, for example a nuclease active Cas9, a Cas9 nickase (nCas9), or a nuclease inactive Cas9 (dCas9). Non-limiting examples of nucleic acid programmable DNA binding proteins include, Cas9 (e.g., dCas9 and nCas9), Type II Cas effector proteins, Type V Cas effector proteins, Type VI Cas effector proteins, CARF, DinG, homologues thereof, or modified or engineered versions thereof. Other nucleic acid programmable DNA binding proteins are also within the scope of this disclosure, although they may not be specifically listed in this disclosure. See, e.g., Makarova et al. "Classification and Nomenclature of CRISPR-Cas Systems: Where from Here?" CRISPR J. 2018 October; 1:325-336. doi: 10.1089/crispr.2018.0033; Yan et al., "Functionally diverse type V CRISPR-Cas systems" Science. 2019 Jan. 4;363 (6422): 88-91. doi: 10.1126/science.aav7271, the entire contents of each are hereby incorporated by reference.

In some embodiments, the nucleic acid programmable DNA binding protein (napDNAbp) of any of the fusion proteins provided herein may be a CasX or CasY protein. In some embodiments, the napDNAbp is a CasX protein. In some embodiments, the napDNAbp is a CasY protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a naturally-occurring CasX or CasY protein. In some embodiments, the napDNAbp is a naturally-occurring CasX or CasY protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any CasX or CasY protein described herein. It should be appreciated that CasX and CasY from other bacterial species may also be used in accordance with the present disclosure.

```
CasX (uniprot.org/uniprot/F0NN87; uniprot.org/uniprot/F0NH53)
>tr|F0NN87|F0NN87_SULIH CRISPR-associated Casx protein OS = Sulfolobus
islandicus (strain HVE10/4) GN = SiH_0402 PE = 4 SV = 1
                                                        (SEQ ID NO: 21)
MEVPLYNIFGDNYIIQVATEAENSTIYNNKVEIDDEELRNVLNLAYKIAKNNEDAAAE

RRGKAKKKKGEEGETTTSNIILPLSGNDKNPWTETLKCYNFPTTVALSEVFKNFSQV

KECEEVSAPSFVKPEFYEFGRSPGMVERTRRVKLEVEPHYLIIAAAGWVLTRLGKAK

VSEGDYVGVNVFTPTRGILYSLIQNVNGIVPGIKPETAFGLWIARKVVSSVTNPNVSV

VRIYTISDAVGQNPTTINGGFSIDLTKLLEKRYLLSERLEAIARNALSISSNMRERYIVL

ANYIYEYLTGSKRLEDLLYFANRDLIMNLNSDDGKVRDLKLISAYVNGELIRGEG

>tr|F0NH53|F0NH53_SULIR CRISPR associated protein, Casx OS = Sulfolo-
bus
islandicus (strain REY15A) GN = SiRe_0771 PE = 4 SV = 1
                                                        (SEQ ID NO: 22)
MEVPLYNIFGDNYIIQVATEAENSTIYNNKVEIDDEELRNVLNLAYKIAKNNEDAAAE

RRGKAKKKKGEEGETTTSNIILPLSGNDKNPWTETLKCYNFPTTVALSEVFKNFSQV

KECEEVSAPSFVKPEFYKFGRSPGMVERTRRVKLEVEPHYLIMAAAGWVLTRLGKA

KVSEGDYVGVNVFTPTRGILYSLIQNVNGIVPGIKPETAFGLWIARKVVSSVTNPNVS

VVSIYTISDAVGQNPTTINGGFSIDLTKLLEKRDLLSERLEAIARNALSISSNMRERYIV

LANYIYEYLTGSKRLEDLLYFANRDLIMNLNSDDGKVRDLKLISAYVNGELIRGEG

CasY (ncbi.nlm.nih.gov/protein/APG80656.1)
>APG80656.1 CRISPR-associated protein CasY [uncultured Parcubacteria
group bacterium]
                                                        (SEQ ID NO: 23)
MSKRHPRISGVKGYRLHAQRLEYTGKSGAMRTIKYPLYSSPSGGRTVPREIVSAINDD

YVGLYGLSNFDDLYNAEKRNEEKVYSVLDFWYDCVQYGAVFSYTAPGLLKNVAEV

RGGSYELTKTLKGSHLYDELQIDKVIKFLNKKEISRANGSLDKLKKDIIDCFKAEYRE

RHKDQCNKLADDIKNAKKDAGASLGERQKKLFRDFFGISEQSENDKPSFTNPLNLTC

CLLPFDTVNNNRNRGEVLFNKLKEYAQKLDKNEGSLEMWEYIGIGNSGTAFSNFLG

EGFLGRLRENKITELKKAMMDITDAWRGQEQEEELEKRLRILAALTIKLREPKFDNH

WGGYRSDINGKLSSWLQNYINQTVKIKEDLKGHKKDLKKAKEMINRFGESDTKEEA

VVSSLLESIEKIVPDDSADDEKPDIPAIAIYRRFLSDGRLTLNRFVQREDVQEALIKERL
```

-continued

```
EAEKKKKPKKRKKKSDAEDEKETIDFKELFPHLAKPLKLVPNFYGDSKRELYKKYK

NAAIYTDALWKAVEKIYKSAFSSSLKNSFFDTDFDKDFFIKRLQKIFSVYRRFNTDKW

KPIVKNSFAPYCDIVSLAENEVLYKPKQSRSRKSAAIDKNRVRLPSTENIAKAGIALA

RELSVAGFDWKDLLKKEEHEEYIDLIELHKTALALLLAVTETQLDISALDFVENGTV

KDFMKTRDGNLVLEGRFLEMFSQSIVFSELRGLAGLMSRKEFITRSAIQTMNGKQAE

LLYIPHEFQSAKITTPKEMSRAFLDLAPAEFATSLEPESLSEKSLLKLKQMRYYPHYFG

YELTRTGQGIDGGVAENALRLEKSPVKKREIKCKQYKTLGRGQNKIVLYVRSSYYQT

QFLEWFLHRPKNVQTDVAVSGSFLIDEKKVKTRWNYDALTVALEPVSGSERVFVSQ

PFTIFPEKSAEEEGQRYLGIDIGEYGIAYTALEITGDSAKILDQNFISDPQLKTLREEVK

GLKLDQRRGTFAMPSTKIARIRESLVHSLRNRIHHLALKHKAKIVYELEVSRFEEGKQ

KIKKVYATLKKADVYSEIDADKNLQTTVWGKLAVASEISASYTSQFCGACKKLWRA

EMQVDETITTQELIGTVRVIKGGTLIDAIKDFMRPPIFDENDTPFPKYRDFCDKHHISK

KMRGNSCLFICPFCRANADADIQASQTIALLRYVKEEKKVEDYFERFRKLKNIKVLG

QMKKI
```

The term "CRISPR-Cas domain" or "CRISPR-Cas DNA binding domain" refers to an RNA-guided protein comprising a CRISPR associated (Cas) protein, or a fragment thereof (e.g., a protein comprising an active, inactive, or partially active DNA cleavage domain of a Cas protein, and/or the gRNA binding domain of Cas protein). CRISPR clusters are transcribed and processed into CRISPR RNA (crRNA). CRISPR clusters are transcribed and processed into CRISPR RNA (crRNA). In some CRISPR systems, correct processing of pre-crRNA requires a trans-encoded small RNA (tracrRNA), endogenous ribonuclease 3 (rnc) and a Cas protein. The tracrRNA serves as a guide for ribonuclease 3-aided processing of pre-crRNA. Subsequently, Cas9/crRNA and/or tracrRNA endonucleolytically cleaves linear or circular dsDNA target complementary to the spacer. In nature, DNA-binding and cleavage may require both RNAs. However, single guide RNAs ("sgRNA", or simply "gNRA") can be engineered so as to incorporate aspects of both the crRNA and tracrRNA into a single RNA species. See, e.g., Jinek M., Chylinski K., Fonfara I., Hauer M., Doudna J.A., Charpentier E. Science 337:816-821 (2012), the entire contents of which is hereby incorporated by reference. Cas proteins recognize a short motif in the CRISPR repeat sequences (the PAM or protospacer adjacent motif) to help distinguish self versus non-self. CRISPR-Cas proteins include without limitation Cas9, CasX, CasY, Cpf1, C2c1, and C2c3 or active fragments thereof. Additional suitable CRISPR-Cas proteins and sequences will be apparent to those of skill in the art based on this disclosure.

A nuclease-inactivated CRISPR-Cas protein may interchangeably be referred to as a "dCas" protein (for nuclease-"dead" Cas) or catalytically inactive Cas. Methods for generating a Cas protein (or a fragment thereof) having an inactive DNA cleavage domain are known (See, e.g., Jinek et al., Science. 337:816-821 (2012); Qi et al., "Repurposing CRISPR as an RNA-Guided Platform for Sequence-Specific Control of Gene Expression" (2013) Cell. 28;152 (5): 1173-83, the entire contents of each of which are incorporated herein by reference). For example, the DNA cleavage domain of Cas9 is known to include two subdomains, the HNH nuclease subdomain and the RuvC1 subdomain. The HNH subdomain cleaves the strand complementary to the gRNA, whereas the RuvCI subdomain cleaves the non-complementary strand. Mutations within these subdomains can silence the nuclease activity of Cas9. For example, the mutations D10A and H840A completely inactivate the nuclease activity of S. pyogenes Cas9 (Jinek et al., Science. 337:816-821 (2012); Qi et al., Cell. 28;152 (5): 1173-83 (2013)). In some embodiments, a Cas nuclease has an inactive (e.g., an inactivated) DNA cleavage domain, that is, the Cas is a nickase, referred to as an "nCas" protein (for "nickase" Cas). A Cas variant shares homology to a CRISPR-Cas protein, or a fragment thereof. For example, a Cas variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to a wild type CRISPR-Cas protein. In some embodiments, the Cas variant may have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more amino acid changes compared to a wild type CRISPR-Cas protein. In some embodiments, the Cas variant comprises a fragment of a CRISPR-Cas protein (e.g., a gRNA programmable DNA binding domain or a DNA-cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of a wild type CRISPR-Cas protein. In some embodiments, the fragment is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild type CRISPR-Cas protein. In some embodiments, the fragment is at least 100 amino acids in length. In some embodiments, the fragment is at least 100, 150, 200, 250, 300, 350, 400, 450, 500, 550, 600, 650, 700, 750, 800, 850, 900, 950, 1000, 1050, 1100, 1150, 1200, 1250, or at least 1300 amino acids in length.

In this disclosure, "comprises," "comprising," "containing" and "having" and the like can have the meaning ascribed to them in U.S. Patent law and can mean "includes," "including," and the like; "consisting essentially of" or "consists essentially" likewise has the meaning ascribed in U.S. Patent law and the term is open-ended, allowing for the presence of more than that which is recited so long as basic or novel characteristics of that which is recited is not changed by the presence of more than that which is recited, but excludes prior art embodiments.

By "cytidine deaminase" is meant a polypeptide or fragment thereof capable of catalyzing a deamination reaction that converts an amino group to a carbonyl group. In one embodiment, the cytidine deaminase converts cytosine to uracil or 5-methylcytosine to thymine. PmCDA1, which is derived from Petromyzon marinus (Petromyzon marinus cytosine deaminase 1, "PmCDA1"), AID (Activation-induced cytidine deaminase; AICDA), which is derived from a mammal (e.g., human, swine, bovine, horse, monkey etc.), and APOBEC are exemplary cytidine deaminases.

The base sequence and amino acid sequence of PmCDA1 and the base sequence and amino acid sequence of CDS of human AID are shown herein below

```
>tr|A5H718|A5H718 PETMA Cytosine deaminase OS = Petromyzon mari-
nus OX = 7757
PE = 2 SV = 1
                                                        (SEQ ID NO: 24)
MTDAEYVRIHEKLDIYTFKKQFFNNKKSVSHRCYVLFELKRRGERRACFWGYAVNKPQSG

TERGIHAEIFSIRKVEEYLRDNPGQFTINWYSSWSPCADCAEKILEWYNQELRGNGHTLK

IWACKLYYEKNARNQIGLWNLRDNGVGLNVMVSEHYQCCRKIFIQSSHNQLNENRWLEKT

LKRAEKRRSELSIMIQVKILHTTKSPAV

>EF094822.1 Petromyzon marinus isolate PmCDA. 21 cytosine deaminase mRNA,
complete cds
                                                        (SEQ ID NO: 25)
TGACACGACACAGCCGTGTATATGAGGAAGGGTAGCTGGATGGGGGGGGGGGAATACGTTCAGAGAGGA

CATTAGCGAGCGTCTTGTTGGTGGCCTTGAGTCTAGACACCTGCAGACATGACCGACGCTGAGTACGTGA

GAATCCATGAGAAGTTGGACATCTACACGTTTAAGAAACAGTTTTTCAACAACAAAAAATCCGTGTCGCA

TAGATGCTACGTTCTCTTTGAATTAAAACGACGGGGTGAACGTAGAGCGTGTTTTTGGGGCTATGCTGTG

AATAAACCACAGAGCGGGACAGAACGTGGAATTCACGCCGAAATCTTTAGCATTAGAAAAGTCGAAGAAT

ACCTGCGCGACAACCCCGGACAATTCACGATAAATTGGTACTCATCCTGGAGTCCTTGTGCAGATTGCGC

TGAAAAGATCTTAGAATGGTATAACCAGGAGCTGCGGGGGAACGGCCACACTTTGAAAATCTGGGCTTGC

AAACTCTATTACGAGAAAAATGCGAGGAATCAAATTGGGCTGTGGAACCTCAGAGATAACGGGGTTGGGT

TGAATGTAATGGTAAGTGAACACTACCAATGTTGCAGGAAAATATTCATCCAATCGTCGCACAATCAATT

GAATGAGAATAGATGGCTTGAGAAGACTTTGAAGCGAGCTGAAAAACGACGGAGCGAGTTGTCCATTATG

ATTCAGGTAAAAATACTCCACACCACTAAGAGTCCTGCTGTTTAAGAGGCTATGCGGATGGTTTTC

>tr|Q6QJ80|Q6QJ80 HUMAN Activation-induced cytidine deaminase OS = Homo
sapiens OX = 9606 GN = AICDA PE = 2 SV = 1
                                                        (SEQ ID NO: 26)
MDSLLMNRRKFLYQFKNVRWAKGRRETYLCYVVKRRDSATSFSLDEGYLRNKNGCHVELL

FLRYISDWDLDPGRCYRVTWFTSWSPCYDCARHVADFLRGNPNLSLRIFTARLYFCEDRK

AEPEGLRRLHRAGVQIAIMTFKAPV

>NG_011588.1:5001-15681 Homo sapiens activation induced cytidine deaminase
(AICDA) , RefSeqGene (LRG 17) on chromosome 12
                                                        (SEQ ID NO: 27)
AGAGAACCATCATTAATTGAAGTGAGATTTTTCTGGCCTGAGACTTGCAGGGAGGCAAGAAGACACTCTG

GACACCACTATGGACAGGTAAAGAGGCAGTCTTCTCGTGGGTGATTGCACTGGCCTTCCTCTCAGAGCAA

ATCTGAGTAATGAGACTGGTAGCTATCCCTTTCTCTCATGTAACTGTCTGACTGATAAGATCAGCTTGAT

CAATATGCATATATATTTTTTGATCTGTCTCCTTTTCTTCTATTCAGATCTTATACGCTGTCAGCCCAAT

TCTTTCTGTTTCAGACTTCTCTTGATTTCCCTCTTTTTCATGTGGCAAAAGAAGTAGTGCGTACAATGTA

CTGATTCGTCCTGAGATTTGTACCATGGTTGAAACTAATTTATGGTAATAATATTAACATAGCAAATCTT

TAGAGACTCAAATCATGAAAAGGTAATAGCAGTACTGTACTAAAAACGGTAGTGCTAATTTTCGTAATAA

TTTTGTAAATATTCAACAGTAAAACAACTTGAAGACACACTTTCCTAGGGAGGCGTTACTGAAATAATTT
```

-continued

```
AGCTATAGTAAGAAAATTTGTAATTTTAGAAATGCCAAGCATTCTAAATTAATTGCTTGAAAGTCACTAT

GATTGTGTCCATTATAAGGAGACAAATTCATTCAAGCAAGTTATTTAATGTTAAAGGCCCAATTGTTAGG

CAGTTAATGGCACTTTTACTATTAACTAATCTTTCCATTTGTTCAGACGTAGCTTAACTTACCTCTTAGG

TGTGAATTTGGTTAAGGTCCTCATAATGTCTTTATGTGCAGTTTTTGATAGGTTATTGTCATAGAACTTA

TTCTATTCCTACATTTATGATTACTATGGATGTATGAGAATAACACCTAATCCTTATACTTTACCTCAAT

TTAACTCCTTTATAAAGAACTTACATTACAGAATAAAGATTTTTTAAAAATATATTTTTTGTAGAGACA

GGGTCTTAGCCCAGCCGAGGCTGGTCTCTAAGTCCTGGCCCAAGCGATCCTCCTGCCTGGGCCTCCTAAA

GTGCTGGAATTATAGACATGAGCCATCACATCCAATATACAGAATAAAGATTTTTAATGGAGGATTTAAT

GTTCTTCAGAAAATTTTCTTGAGGTCAGACAATGTCAAATGTCTCCTCAGTTTACACTGAGATTTTGAAA

ACAAGTCTGAGCTATAGGTCCTTGTGAAGGGTCCATTGGAAATACTTGTTCAAAGTAAAATGGAAAGCAA

AGGTAAAATCAGCAGTTGAAATTCAGAGAAAGACAGAAAAGGAGAAAAGATGAAATTCAACAGGACAGAA

GGGAAATATATTATCATTAAGGAGGACAGTATCTGTAGAGCTCATTAGTGATGGCAAAATGACTTGGTCA

GGATTATTTTTAACCCGCTTGTTTCTGGTTTGCACGGCTGGGGATGCAGCTAGGGTTCTGCCTCAGGGAG

CACAGCTGTCCAGAGCAGCTGTCAGCCTGCAAGCCTGAAACACTCCCTCGGTAAAGTCCTTCCTACTCAG

GACAGAAATGACGAGAACAGGGAGCTGGAAACAGGCCCCTAACCAGAGAAGGGAAGTAATGGATCAACAA

AGTTAACTAGCAGGTCAGGATCACGCAATTCATTTCACTCTGACTGGTAACATGTGACAGAAACAGTGTA

GGCTTATTGTATTTTCATGTAGAGTAGGACCCAAAAATCCACCCAAAGTCCTTTATCTATGCCACATCCT

TCTTATCTATACTTCCAGGACACTTTTTCTTCCTTATGATAAGGCTCTCTCTCTCCACACACACACAC

ACACACACACACACACACACACACACACACAAACACACACCCCGCCAACCAAGGTGCATGTAAAAAGA

TGTAGATTCCTCTGCCTTTCTCATCTACACAGCCCAGGAGGGTAAGTTAATATAAGAGGGATTTATTGGT

AAGAGATGATGCTTAATCTGTTTAACACTGGGCCTCAAAGAGAGAATTTCTTTTCTTCTGTACTTATTAA

GCACCTATTATGTGTTGAGCTTATATATACAAAGGGTTATTATATGCTAATATAGTAATAGTAATGGTGG

TTGGTACTATGGTAATTACCATAAAAATTATTATCCTTTTAAAATAAAGCTAATTATTATTGGATCTTTT

TTAGTATTCATTTTATGTTTTTTATGTTTTTGATTTTTTAAAAGACAATCTCACCCTGTTACCCAGGCTG

GAGTGCAGTGGTGCAATCATAGCTTTCTGCAGTCTTGAACTCCTGGGCTCAAGCAATCCTCCTGCCTTGG

CCTCCCAAAGTGTTGGGATACAGTCATGAGCCACTGCATCTGGCCTAGGATCCATTTAGATTAAAATATG

CATTTTAAATTTTAAAATAATATGGCTAATTTTTACCTTATGTAATGTGTATACTGGCAATAAATCTAGT

TTGCTGCCTAAAGTTTAAAGTGCTTTCCAGTAAGCTTCATGTACGTGAGGGGAGACATTTAAAGTGAAAC

AGACAGCCAGGTGTGGTGGCTCACGCCTGTAATCCCAGCACTCTGGGAGGCTGAGGTGGGTGGATCGCTT

GAGCCCTGGAGTTCAAGACCAGCCTGAGCAACATGGCAAAACGCTGTTTCTATAACAAAAATTAGCCGGG

CATGGTGGCATGTGCCTGTGGTCCCAGCTACTAGGGGGCTGAGGCAGGAGAATCGTTGGAGCCCAGGAGG

TCAAGGCTGCACTGAGCAGTGCTTGCGCCACTGCACTCCAGCCTGGGTGACAGGACCAGACCTTGCCTCA

AAAAAATAAGAAGAAAAATTAAAAATAAATGGAAACAACTACAAAGAGCTGTTGTCCTAGATGAGCTACT

TAGTTAGGCTGATATTTTGGTATTTAACTTTTAAAGTCAGGGTCTGTCACCTGCACTACATTATTAAAAT

ATCAATTCTCAATGTATATCCACACAAAGACTGGTACGTGAATGTTCATAGTACCTTTATTCACAAAACC

CCAAAGTAGAGACTATCCAAATATCCATCAACAAGTGAACAAATAAACAAATGTGCTATATCCATGCAA

TGGAATACCACCCTGCAGTACAAAGAAGCTACTTGGGGATGAATCCCAAAGTCATGACGCTAAATGAAAG

AGTCAGACATGAAGGAGGAGATAATGTATGCCATACGAAATTCTAGAAAATGAAAGTAACTTATAGTTAC

AGAAAGCAAATCAGGGCAGGCATAGAGGCTCACACCTGTAATCCCAGCACTTTGAGAGGCCACGTGGGAA

GATTGCTAGAACTCAGGAGTTCAAGACCAGCCTGGGCAACACAGTGAAACTCCATTCTCCACAAAAATGG
```

-continued

```
GAAAAAAAGAAAGCAAATCAGTGGTTGTCCTGTGGGGAGGGAAGGACTGCAAAGAGGGAAGAAGCTCTG

GTGGGGTGAGGGTGGTGATTCAGGTTCTGTATCCTGACTGTGGTAGCAGTTTGGGGTGTTTACATCCAAA

AATATTCGTAGAATTATGCATCTTAAATGGGTGGAGTTTACTGTATGTAAATTATACCTCAATGTAAGAA

AAAATAATGTGTAAGAAAACTTTCAATTCTCTTGCCAGCAAACGTTATTCAAATTCCTGAGCCCTTTACT

TCGCAAATTCTCTGCACTTCTGCCCCGTACCATTAGGTGACAGCACTAGCTCCACAAATTGGATAAATGC

ATTTCTGGAAAAGACTAGGGACAAAATCCAGGCATCACTTGTGCTTTCATATCAACCATGCTGTACAGCT

TGTGTTGCTGTCTGCAGCTGCAATGGGACTCTTGATTTCTTTAAGGAAACTTGGGTTACCAGAGTATTT

CCACAAATGCTATTCAAATTAGTGCTTATGATATGCAAGACACTGTGCTAGGAGCCAGAAAACAAAGAGG

AGGAGAAATCAGTCATTATGTGGGAACAACATAGCAAGATATTTAGATCATTTTGACTAGTTAAAAAGC

AGCAGAGTACAAAATCACACATGCAATCAGTATAATCCAAATCATGTAAATATGTGCCTGTAGAAAGACT

AGAGGAATAAACACAAGAATCTTAACAGTCATTGTCATTAGACACTAAGTCTAATTATTATTATTAGACA

CTATGATATTTGAGATTTAAAAAATCTTTAATATTTTAAAATTTAGAGCTCTTCTATTTTTCCATAGTAT

TCAAGTTTGACAATGATCAAGTATTACTCTTTCTTTTTTTTTTTTTTTTTTTTTGAGATGGAGTTT

TGGTCTTGTTGCCCATGCTGGAGTGGAATGGCATGACCATAGCTCACTGCAACCTCCACCTCCTGGGTTC

AAGCAAAGCTGTCGCCTCAGCCTCCCGGGTAGATGGGATTACAGGCGCCCACCACCACACTCGGCTAATG

TTTGTATTTTTAGTAGAGATGGGGTTTCACCATGTTGGCCAGGCTGGTCTCAAACTCCTGACCTCAGAGG

ATCCACCTGCCTCAGCCTCCCAAAGTGCTGGGATTACAGATGTAGGCCACTGCGCCCGGCCAAGTATTGC

TCTTATACATTAAAAAACAGGTGTGAGCCACTGCGCCCAGCCAGGTATTGCTCTTATACATTAAAAAATA

GGCCGGTGCAGTGGCTCACGCCTGTAATCCCAGCACTTTGGGAAGCCAAGGCGGGCAGAACACCCGAGGT

CAGGAGTCCAAGGCCAGCCTGGCCAAGATGGTGAAACCCCGTCTCTATTAAAAATACAAACATTACCTGG

GCATGATGGTGGGCGCCTGTAATCCCAGCTACTCAGGAGGCTGAGGCAGGAGGATCCGCGGAGCCTGGCA

GATCTGCCTGAGCCTGGGAGGTTGAGGCTACAGTAAGCCAAGATCATGCCAGTATACTTCAGCCTGGGCG

ACAAAGTGAGACCGTAACAAAAAAAAAAAATTTAAAAAAAGAAATTTAGATCAAGATCCAACTGTAAAA

AGTGGCCTAAACACCACATTAAAGAGTTTGGAGTTTATTCTGCAGGCAGAAGAGAACCATCAGGGGTCT

TCAGCATGGGAATGGCATGGTGCACCTGGTTTTTGTGAGATCATGGTGGTGACAGTGTGGGAATGTTAT

TTTGGAGGGACTGGAGGCAGACAGACCGGTTAAAAGGCCAGCACAACAGATAAGGAGGAAGAAGATGAGG

GCTTGGACCGAAGCAGAGAAGAGCAAACAGGGAAGGTACAAATTCAAGAAATATTGGGGGGTTTGAATCA

ACACATTTAGATGATTAATTAAATATGAGGACTGAGGAATAAGAAATGAGTCAAGGATGGTTCCAGGCTG

CTAGGCTGCTTACCTGAGGTGGCAAAGTCGGGAGGAGTGGCAGTTTAGGACAGGGGGCAGTTGAGGAATA

TTGTTTTGATCATTTTGAGTTTGAGGTACAAGTTGGACACTTAGGTAAAGACTGGAGGGGAAATCTGAAT

ATACAATTATGGGACTGAGGAACAAGTTTATTTTATTTTTTGTTTCGTTTTCTTGTTGAAGAACAAATTT

AATTGTAATCCCAAGTCATCAGCATCTAGAAGACAGTGGCAGGAGGTGACTGTCTTGTGGGTAAGGGTTT

GGGGTCCTTGATGAGTATCTCTCAATTGGCCTTAAATATAAGCAGGAAAAGGAGTTTATGATGGATTCCA

GGCTCAGCAGGGCTCAGGAGGGCTCAGGCAGCCAGCAGAGGAAGTCAGAGCATCTTCTTTGGTTTAGCCC

AAGTAATGACTTCCTTAAAAAGCTGAAGGAAAATCCAGAGTGACCAGATTATAAACTGTACTCTTGCATT

TTCTCTCCCTCCTCTCACCCACAGCCTCTTGATGAACCGGAGGAAGTTTCTTTACCAATTCAAAAATGTC

CGCTGGGCTAAGGGTCGGCGTGAGACCTACCTGTGCTACGTAGTGAAGAGGCGTGACAGTGCTACATCCT

TTTCACTGGACTTTGGTTATCTTCGCAATAAGGTATCAATTAAAGTCGGCTTTGCAAGCAGTTTAATGGT

CAACTGTGAGTGCTTTTAGAGCCACCTGCTGATGGTATTACTTCCATCCTTTTTTGGCATTTGTGTCTCT

ATCACATTCCTCAAATCCTTTTTTTTATTTCTTTTTCCATGTCCATGCACCCATATTAGACATGGCCCAA

AATATGTGATTTAATTCCTCCCCAGTAATGCTGGGCACCCTAATACCACTCCTTCCTTCAGTGCCAAGAA
```

-continued

```
CAACTGCTCCCAAACTGTTTACCAGCTTTCCTCAGCATCTGAATTGCCTTTGAGATTAATTAAGCTAAAA

GCATTTTTATATGGGAGAATATTATCAGCTTGTCCAAGCAAAAATTTTAAATGTGAAAAACAAATTGTGT

CTTAAGCATTTTTGAAAATTAAGGAAGAAGAATTTGGGAAAAAATTAACGGTGGCTCAATTCTGTCTTCC

AAATGATTTCTTTTCCCTCCTACTCACATGGGTCGTAGGCCAGTGAATACATTCAACATGGTGATCCCCA

GAAAACTCAGAGAAGCCTCGGCTGATGATTAATTAAATTGATCTTTCGGCTACCCGAGAGAATTACATTT

CCAAGAGACTTCTTCACCAAAATCCAGATGGGTTTACATAAACTTCTGCCCACGGGTATCTCCTCTCTCC

TAACACGCTGTGACGTCTGGGCTTGGTGGAATCTCAGGGAAGCATCCGTGGGGTGGAAGGTCATCGTCTG

GCTCGTTGTTTGATGGTTATATTACCATGCAATTTTCTTTGCCTACATTTGTATTGAATACATCCCAATC

TCCTTCCTATTCGGTGACATGACACATTCTATTTCAGAAGGCTTTGATTTTATCAAGCACTTTCATTTAC

TTCTCATGGCAGTGCCTATTACTTCTCTTACAATACCCATCTGTCTGCTTTACCAAAATCTATTTCCCCT

TTTCAGATCCTCCCAAATGGTCCTCATAAACTGTCCTGCCTCCACCTAGTGGTCCAGGTATATTTCCACA

ATGTTACATCAACAGGCACTTCTAGCCATTTTCCTTCTCAAAAGGTGCAAAAAGCAACTTCATAAACACA

AATTAAATCTTCGGTGAGGTAGTGTGATGCTGCTTCCTCCCAACTCAGCGCACTTCGTCTTCCTCATTCC

ACAAAAACCCATAGCCTTCCTTCACTCTGCAGGACTAGTGCTGCCAAGGGTTCAGCTCTACCTACTGGTG

TGCTCTTTTGAGCAAGTTGCTTAGCCTCTCTGTAACACAAGGACAATAGCTGCAAGCATCCCCAAAGATC

ATTGCAGGAGACAATGACTAAGGCTACCAGAGCCGCAATAAAAGTCAGTGAATTTTAGCGTGGTCCTCTC

TGTCTCTCCAGAACGGCTGCCACGTGGAATTGCTCTTCCTCCGCTACATCTCGGACTGGGACCTAGACCC

TGGCCGCTGCTACCGCGTCACCTGGTTCACCTCCTGGAGCCCCTGCTACGACTGTGCCCGACATGTGGCC

GACTTTCTGCGAGGGAACCCCAACCTCAGTCTGAGGATCTTCACCGCGCGCCTCTACTTCTGTGAGGACC

GCAAGGCTGAGCCCGAGGGGCTGCGGCGGCTGCACCGCGCCGGGGTGCAAATAGCCATCATGACCTTCAA

AGGTGCGAAAGGGCCTTCCGCGCAGGCGCAGTGCAGCAGCCCGCATTCGGGATTGCGATGCGGAATGAAT

GAGTTAGTGGGGAAGCTCGAGGGGAAGAAGTGGGCGGGGATTCTGGTTCACCTCTGGAGCCGAAATTAAA

GATTAGAAGCAGAGAAAAGAGTGAATGGCTCAGAGACAAGGCCCCGAGGAAATGAGAAAATGGGGCCAGG

GTTGCTTCTTTCCCCTCGATTTGGAACCTGAACTGTCTTCTACCCCCATATCCCCGCCTTTTTTCCTTT

TTTTTTTTTTGAAGATTATTTTTACTGCTGGAATACTTTTGTAGAAAACCACGAAAGAACTTTCAAAGCC

TGGGAAGGGCTGCATGAAAATTCAGTTCGTCTCTCCAGACAGCTTCGGCGCATCCTTTTGGTAAGGGGCT

TCCTCGCTTTTTAAATTTTCTTTCTTTCTCTACAGTCTTTTTTGGAGTTTCGTATATTTCTTATATTTTC

TTATTGTTCAATCACTCTCAGTTTTCATCTGATGAAAACTTTATTTCTCCTCCACATCAGCTTTTTCTTC

TGCTGTTTCACCATTCAGAGCCCTCTGCTAAGGTTCCTTTTCCCTCCCTTTTCTTTCTTTTGTTGTTTCA

CATCTTTAAATTTCTGTCTCTCCCCAGGGTTGCGTTTCCTTCCTGGTCAGAATTCTTTTCTCCTTTTTTT

TTTTTTTTTTTTTTTTAAACAAACAAACAAAAAACCCAAAAAAACTCTTTCCCAATTTACTTTCTT

CCAACATGTTACAAAGCCATCCACTCAGTTTAGAAGACTCTCCGGCCCCACCGACCCCCAACCTCGTTTT

GAAGCCATTCACTCAATTTGCTTCTCTCTTTCTCTACAGCCCCTGTATGAGGTTGATGACTTACGAGACG

CATTTCGTACTTTGGGACTTTGATAGCAACTTCCAGGAATGTCACACACGATGAAATATCTCTGCTGAAG

ACAGTGGATAAAAAACAGTCCTTCAAGTCTTCTCTGTTTTATTCTTCAACTCTCACTTTCTTAGAGTTT

ACAGAAAAATATTTATATACGACTCTTTAAAAAGATCTATGTCTTGAAAATAGAGAAGGAACACAGGTC

TGGCCAGGGACGTGCTGCAATTGGTGCAGTTTTGAATGCAACATTGTCCCCTACTGGGAATAACAGAACT

GCAGGACCTGGGAGCATCCTAAAGTGTCAACGTTTTCTATGACTTTTAGGTAGGATGAGAGCAGAAGGT

AGATCCTAAAAAGCATGGTGAGAGGATCAAATGTTTTTATATCAACATCCTTTATTATTTGATTCATTTG

AGTTAACAGTGGTGTTAGTGATAGATTTTCTATTCTTTTCCCTTGACGTTTACTTTCAAGTAACACAAA
```

```
CTCTTCCATCAGGCCATGATCTATAGGACCTCCTAATGAGAGTATCTGGGTGATTGTGACCCCAAACCAT

CTCTCCAAAGCATTAATATCCAATCATGCGCTGTATGTTTTAATCAGCAGAAGCATGTTTTTATGTTTGT

ACAAAAGAAGATTGTTATGGGTGGGGATGGAGGTATAGACCATGCATGGTCACCTTCAAGCTACTTTAAT

AAAGGATCTTAAAATGGGCAGGAGGACTGTGAACAAGACACCCTAATAATGGGTTGATGTCTGAAGTAGC

AAATCTTCTGGAAACGCAAACTCTTTTAAGGAAGTCCCTAATTTAGAAACACCCACAAACTTCACATATC

ATAATTAGCAAACAATTGGAAGGAAGTTGCTTGAATGTTGGGGAGAGGAAAATCTATTGGCTCTCGTGGG

TCTCTTCATCTCAGAAATGCCAATCAGGTCAAGGTTTGCTACATTTTGTATGTGTGTGATGCTTCTCCCA

AAGGTATATTAACTATATAAGAGAGTTGTGACAAAACAGAATGATAAAGCTGCGAACCGTGGCACACGCT

CATAGTTCTAGCTGCTTGGGAGGTTGAGGAGGGAGGATGGCTTGAACACAGGTGTTCAAGGCCAGCCTGG

GCAACATAACAAGATCCTGTCTCTCAAAAAAAAAAAAAAAAAAAAGAAAGAGAGAGGGCCGGGCGTGGTG

GCTCACGCCTGTAATCCCAGCACTTTGGGAGGCCGAGCCGGGCGGATCACCTGTGGTCAGGAGTTTGAGA

CCAGCCTGGCCAACATGGCAAAACCCCGTCTGTACTCAAAATGCAAAAATTAGCCAGGCGTGGTAGCAGG

CACCTGTAATCCCAGCTACTTGGGAGGCTGAGGCAGGAGAATCGCTTGAACCCAGGAGGTGGAGGTTGCA

GTAAGCTGAGATCGTGCCGTTGCACTCCAGCCTGGGCGACAAGAGCAAGACTCTGTCTCAGAAAAAAAAA

AAAAAAGAGAGAGAGAGAAAGAGAACAATATTTGGGAGAGAAGGATGGGGAAGCATTGCAAGGAAAT

TGTGCTTTATCCAACAAAATGTAAGGAGCCAATAAGGGATCCCTATTTGTCTCTTTTGGTGTCTATTTGT

CCCTAACAACTGTCTTTGACAGTGAGAAAAATATTCAGAATAACCATATCCCTGTGCCGTTATTACCTAG

CAACCCTTGCAATGAAGATGAGCAGATCCACAGGAAAACTTGAATGCACAACTGTCTTATTTTAATCTTA

TTGTACATAAGTTTGTAAAAGAGTTAAAAATTGTTACTTCATGTATTCATTTATATTTTATATTATTTTG

CGTCTAATGATTTTTTATTAACATGATTTCCTTTTCTGATATATTGAAATGGAGTCTCAAAGCTTCATAA

ATTTATAACTTTAGAAATGATTCTAATAACAACGTATGTAATTGTAACATTGCAGTAATGGTGCTACGAA

GCCATTTCTCTTGATTTTTAGTAAACTTTTATGACAGCAAATTTGCTTCTGGCTCACTTTCAATCAGTTA

AATAAATGATAAATAATTTTGGAAGCTGTGAAGATAAAATACCAAATAAAATAATATAAAAGTGATTTAT

ATGAAGTTAAAATAAAAAATCAGTATGATGGAATAAACTTG
```

Apolipoprotein B mRNA editing enzyme, catalytic polypeptide-like (APOBEC) is a family of evolutionarily conserved cytidine deaminases. Members of this family are C-to-U editing enzymes. The N-terminal domain of APOBEC like proteins is the catalytic domain, while the C-terminal domain is a pseudocatalytic domain. More specifically, the catalytic domain is a zinc dependent cytidine deaminase domain and is important for cytidine deamination. APOBEC family members include APOBEC1, APOBEC2, APOBEC3A, APOBEC3B, APOBEC3C, APOBEC3D ("APOBEC3E" now refers to this), APOBEC3F, APOBEC3G, APOBEC3H, APOBEC4, and Activation-induced (cytidine) deaminase. A number of modified cytidine deaminases are commercially available, including but not limited to SaBE3, SaKKH-BE3, VQR-BE3, EQR-BE3, VRER-BE3, YE1-BE3, EE-BE3, YE2-BE3, and YEE-BE3, which are available from Addgene (plasmids 85169, 85170, 85171, 85172, 85173, 85174, 85175, 85176, 85177).

Other exemplary deaminases that can be fused to Cas9 according to aspects of this disclosure are provided below. It should be understood that, in some embodiments, the active domain of the respective sequence can be used, e.g., the domain without a localizing signal (nuclear localization sequence, without nuclear export signal, cytoplasmic localizing signal).

```
Human AID:
                                                    (SEQ ID NO: 28)
MDSLLMNRRKFLYQFKNVRWAKGRRETYLCYVVKRRDSATSFSLDEGYLRNKNGCHVELLFL

RYISDWDLDPGRCYRVTWFTSWSPCYDCARHVADFLRGNPNLSLRIFTARLYFCEDRKAEPE

GLRRLHRAGVQIAIMTFKDYFYCWNTEVENHERTFKAWEGLHENSVRLSRQLRRILLPLYEV

DDLRDAFRTLGL  (underline: nuclear localization sequence; double underline: nuclear export signal)
```

-continued

Mouse AID:
(SEQ ID NO: 29)
MDSLLMKQKKFLYHFKNVRWAKGRHETYLCYVVKRRDSATSCSLDFGHLRNKSGCHVELLFL
RYISDWDLDPGRCYRVTWFTSWSPCYDCARHVAEFLRWNPNLSLRIFTARLYFCEDRKAEPE
GLRRLHRAGVQIGIMTFKDYFYCWNTFVENRERTFKAWEGLHENSVRLTRQLRRILLPLYEV
DDLRDAFRMLGF (underline: nuclear localization sequence; double
underline: nuclear export signal)

Canine AID:
(SEQ ID NO: 30)
MDSLLMKQRKFLYHFKNVRWAKGRHETYLCYVVKRRDSATSFSLDFGHLRNKSGCHVELLFL
RYISDWDLDPGRCYRVTWFTSWSPCYDCARHVADFLRGYPNLSLRIFAARLYFCEDRKAEPE
GLRRLHRAGVQIAIMTFKDYFYCWNTFVENREKTFKAWEGLHENSVRLSRQLRRILLPLYEV
DDLRDAFRTLGL (underline: nuclear localization sequence; double
underline: nuclear export signal)

Bovine AID:
(SEQ ID NO: 31)
MDSLLKKQRQFLYQFKNVRWAKGRHETYLCYVVKRRDSPTSFSLDEGHLRNKAGCHVELLFL
RYISDWDLDPGRCYRVTWFTSWSPCYDCARHVADFLRGYPNLSLRIFTARLYFCDKERKAEP
EGLRRLHRAGVQIAIMTFKDYFYCWNTEVENHERTFKAWEGLHENSVRLSRQLRRILLPLYE
VDDLRDAFRTLGL (underline: nuclear localization sequence; double
underline: nuclear export signal)

Rat AID
(SEQ ID NO: 32)
MAVGSKPKAALVGPHWERERIWCFLCSTGLGTQQTGQTSRWLRPAATQDPVSPPRSLLMKQR
KFLYHFKNVRWAKGRHETYLCYVVKRRDSATSESLDFGYLRNKSGCHVELLFLRYISDWDLD
PGRCYRVTWFTSWSPCYDCARHVADFLRGNPNLSLRIFTARLTGWGALPAGLMSPARPSDYF
YCWNTFVENHERTFKAWEGLHENSVRLSRRLRRILLPLYEVDDLRDAFRTLGL
(underline: nuclear localization sequence; double underline:
nuclear export signal)

Mouse APOBEC-3
(SEQ ID NO: 33)
MGPFCLGCSHRKCYSPIRNLISQETFKFHFKNLGYAKGRKDTFLCYEVTRKDCDSPVSLHHGVFKNKD
NIHAEICFLYWFHDKVLKVLSPREEFKITWYMSWSPCFECAEQIVRFLATHHNLSLDIFSSRLYNVQD
PETQQNLCRLVQEGAQVAAMDLYEFKKCWKKFVDNGGRRFRPWKRLLTNFRYQDSKLQEILRPCYIPV
PSSSSSTLSNICLTKGLPETRFCVEGRRMDPLSEEEFYSQFYNQRVKHLCYYHRMKPYLCYQLEQENG
QAPLKGCLLSEKGKQHAEILFLDKIRSMELSQVTITCYLTWSPCPNCAWQLAAFKRDRPDLILHIYTS
RLYFHWKRPFQKGLCSLWQSGILVDVMDLPQFTDCWTNFVNPKRPFWPWKGLEIISRRTQRRLRRIKE
SWGLQDLVNDFGNLQLGPPMS (italic: nucleic acid editing domain)

Rat APOBEC-3:
(SEQ ID NO: 34)
MGPFCLGCSHRKCYSPIRNLISQETFKFHFKNRLRYAIDRKDTFLCYEVTRKDCDSPVSLHHGVFKNK
DNIHAEICFLYWFHDKVLKVLSPREEFKITWYMSWSPCFECAEQVLRFLATHHNLSLDIFSSRLYNIR
DPENQQNLCRLVQEGAQVAAMDLYEFKKCWKKFVDNGGRRFRPWKKLLTNFRYQDSKLQEILRPCYIP
VPSSSSSTLSNICLTKGLPETRFCVERRVHLLSEEEFYSQFYNQRVKHLCYYHGVKPYLCYQLEQFN
GQAPLKGCLLSEKGKQHAEILFLDKIRSMELSQVIITCYLTWSPCPNCAWQLAAFKRDRPDLILHIYT

-continued

SRLYFHWKRPFQKGLCSLWQSGILVDVMDLPQFTDCWTNFVNPKRPFWPWKGLEIISRRTQRRLHRIK

ESWGLQDLVNDFGNLQLGPPMS (italic: nucleic acid editing domain)

Rhesus macaque APOBEC-3 G:
(SEQ ID NO: 35)
<u>MVEPMDPRTFVSNFNNRPILSGLNTVWLCCEVKTKDPSGPPLDAKIFQGKVYSKAKYHPEMR</u>

FLRWFPHKWRQLHHDQEYKVTWYVSWSPCTRCANSVATFLAKDPKVTLTIFVARLYYFWKPDY

QQALRILCQKRGGPHATMKIMNYNEFQDCWNKFVDGRGKPFKPRNNLPKHYTLLQATLGELL

RHLMDPGTFTSNENNKPWVSGQHETYLCYKVERLHNDTWVPLNQHRGFLRNQAPNIHGFPKG

RHAELCFLDLIPFWKLDGQQYRVTCFTSWSPCESCAQEMAKFISNNEHVSLCIFAARIYDDQ

GRYQEGLRALHRDGAKIAMMNYSEFEYCWDTFVDRQGRPFQPWDGLDEHSQALSGRLRAI (italic: nucleic acid editing domain; underline: cytoplasmic localization signal)

Chimpanzee APOBEC-3 G:
(SEQ ID NO: 36)
<u>MKPHFRNPVERMYQDTFSDNFYNRPILSHRNTVWLCYEVKTKGPSRPPLDAKIFRGQVYSKLKY</u>*HPEM*

*RFFHWFSKWRKLHRDQEYEVTWYISWSPCTKC*TRDVATFLAEDPKVTLTIFVARLYYFWDPDYQEALR

SLCQKRDGPRATMKIMNYDEFQHCWSKFVYSQRELFEPWNNLPKYYILLHIMLGEILRHSMDPPTFTS

NFNNELWVRGRHETYLCYEVERLHNDTWVLLNQRRGELCNQAPHKHGFLEGR*HAELCFLDVIPFWKLD*

LHQDYRVTCFTSWSPCFSCAQEMAKFISNNKHVSLCIFAARIYDDQGRCQEGLRTLAKAGAKISIMTY

SEFKHCWDTFVDHQGCPFQPWDGLEEHSQALSGRLRAILQNQGN (italic: nucleic acid editing domain; underline: cytoplasmic localization signal)

Green monkey APOBEC-3G:
(SEQ ID NO: 37)
<u>MNPQIRNMVEQMEPDIFVYYFNNRPILSGRNTVWLCYEVKTKDPSGPPLDANIFQGKLYPEAKD</u>*HPEM*

*KFLHWFRKWRQLHRDQEYEVTWYVSWSPCTRC*ANSVATFLAEDPKVTLTIFVARLYYFWKPDYQQALR

ILCQERGGPHATMKIMNYNEFQHCWNEFVDGQGKPFKPRKNLPKHYTLLHATLGELLRHVMDPGTFTS

NFNNKPWVSGQRETYLCYKVERSHNDTWVLLNQHRGFLRNQAPDRHGFPKGR*HAELCFLDLIPFWKLD*

*DQQYRVTCFTSWSPCFSC*AQKMAKFISNNKHVSLCIFAARIYDDQGRCQEGLRTLHRDGAKIAVMNYS

EFEYCWDTFVDRQGRPFQPWDGLDEHSQALSGRLRAI (italic: nucleic acid editing domain; underline: cytoplasmic localization signal)

Human APOBEC-3G:
(SEQ ID NO: 38)
<u>MKPHFRNTVERMYRDTFSYNFYNRPILSRRNTVWLCYEVKTKGPSRPPLDAKIFRGQVYSELKY</u>*HPEM*

*RFFHWFSKWRKLHRDQEYEVTWYISWSPCTKC*TRDMATFLAEDPKVTLTIFVARLYYFWDPDYQEALR

SLCQKRDGPRATMKIMNYDEFQHCWSKFVYSQRELFEPWNNLPKYYILLHIMLGEILRHSMDPPTFTF

NFNNEPWVRGRHETYLCYEVERMHNDTWVLLNQRRGFLCNQAPHKHGFLEGR*HAELCFLDVIPFWKLD*

*LDQDYRVTCFTSWSPCFSC*AQEMAKFISKNKHVSLCIFTARIYDDQGRCQEGLRTLAEAGAKISIMTY

SEFKHCWDTFVDHQGCPFQPWDGLDEHSQDLSGRLRAILQNQEN (italic: nucleic acid editing domain; underline: cytoplasmic localization signal)

Human APOBEC-3F:

(SEQ ID NO: 39)
MKPHFRNTVERMYRDTFSYNFYNRPILSRRNTVWLCYEVKTKGPSRPRLDAKIFRGQVYSQPEH*HAEM*
*CFLSWFCGNQLPAYKCFQITWFVSWTPC*PDCVAKLAEFLAEHPNVTLTISAARLYYYWERDYRRALCR
LSQAGARVKIMDDEEFAYCWENFVYSEGQPFMPWYKFDDNYAFLHRTLKEILRNPMEAMYPHIFYFHF
KNLRKAYGRNESWLCFTMEVVKHHSPVSWKRGVFRNQVDPETH*CHAERCFLSWFCDDILSPNTNYEVT*
*WYTSWSPCPEC*AGEVAEFLARHSNVNLTIFTARLYYFWDTDYQEGLRSLSQEGASVEIMGYKDFKYCW
ENFVYNDDEPFKPWKGLKYNFLFLDSKLQEILE (italic: nucleic acid editing domain)

Human APOBEC-3B:

(SEQ ID NO: 40)
MNPQIRNPMERMYRDTFYDNFENEPILYGRSYTWLCYEVKIKRGRSNLLWDTGVFRGQVYFKPQY*HAE*
*MCFLSWFCGNQLPAYKCFQITWFVSWTPCPDC*VAKLAEFLSEHPNVTLTISAARLYYYWERDYRRALC
RLSQAGARVTIMDYEEFAYCWENFVYNEGQQFMPWYKEDENYAFLHRTLKEILRYLMDPDTFTENENN
DPLVLRRRQTYLCYEVERLDNGTWVLMDQHMGFLCNEAKNLLCGFY*GRHAELRFLDLVPSLQLDPAQI*
*YRVTWFISWSPCFSWGC*AGEVRAFLQENTHVRLRIFAARIYDYDPLYKEALQMLRDAGAQVSIMTYDE
FEYCWDTFVYRQGCPFQPWDGLEEHSQALSGRLRAILQNGN (italic: nucleic acid editing domain)

Rat APOBEC-3B:

(SEQ ID NO: 41)
MQPQGLGPNAGMGPVCLGCSHRRPYSPIRNPLKKLYQQTFYFHFKNVRYAWGRKNNFLCYEVNGMDCA
LPVPLRQGVFRKQGHIHAELCFIYWFHDKVLRVLSPMEEFKVTWYMSWSPCSKCAEQVARFLAAHRNL
SLAIFSSRLYYYLRNPNYQQKLCRLIQEGVHVAAMDLPEFKKCWNKFVDNDGQPFRPWMRLRINESFY
DCKLQEIFSRMNLLREDVFYLQFNNSHRVKPVQNRYYRRKSYLCYQLERANGQEPLKGYLLYKKGEQH
VEILFLEKMRSMELSQVRITCYLTWSPCPNCARQLAAFKKDHPDLILRIYTSRLYFWRKKFQKGLCTL
WRSGIHVDVMDLPQFADCWTNFVNPQRPFRPWNELEKNSWRIQRRLRRIKESWGL

Bovine APOBEC-3B:

(SEQ ID NO: 42)
DGWEVAFRSGTVLKAGVLGVSMTEGWAGSGHPGQGACVWTPGTRNTMNLLREVLFKQQFGNQPRVPAP
YYRRKTYLCYQLKQRNDLTLDRGCFRNKKQRHAERFIDKINSLDLNPSQSYKIICYITWSPCPNCANE
LVNFITRNNHLKLEIFASRLYFHWIKSFKMGLQDLQNAGISVAVMTHTEFEDCWEQFVDNQSRPFQPW
DKLEQYSASIRRRLQRILTAPI

Chimpanzee APOBEC-3B:

(SEQ ID NO: 43)
MNPQIRNPMEWMYQRTFYYNFENEPILYGRSYTWLCYEVKIRRGHSNLLWDTGVERGQMYSQPEHHAE
MCFLSWFCGNQLSAYKCFQITWFVSWTPCPDCVAKLAKFLAEHPNVTLTISAARLYYYWERDYRRALC
RLSQAGARVKIMDDEEFAYCWENFVYNEGQPFMPWYKFDDNYAFLHRTLKEIIRHLMDPDTFTENENN
DPLVLRRHQTYLCYEVERLDNGTWVLMDQHMGFLCNEAKNLLCGFYGRHAELRFLDLVPSLQLDPAQI
YRVTWFISWSPCFSWGCAGQVRAFLQENTHVRLRIFAARIYDYDPLYKEALQMLRDAGAQVSIMTYDE
FEYCWDTFVYRQGCPFQPWDGLEEHSQALSGRLRAILQVRASSLCMVPHRPPPPPQSPGPCLPLCSEP
PLGSLLPTGRPAPSLPFLLTASFSFPPPASLPPLPSLSLSPGHLPVPSFHSLTSCSIQPPCSSRIRET
EGWASVSKEGRDLG

-continued

Human APOBEC-3C:
(SEQ ID NO: 44)
MNPQIRNPMKAMYPGTFYFQFKNLWEANDRNETWLCFTVEGIKRRSVVSWKTGVFRNQVDSETH*CHAE*
*RCFLSWFCDDILSPNTKYQVTWYTSWSPCPD*CAGEVAEFLARHSNVNLTIFTARLYYFQYPCYQEGLR
SLSQEGVAVEIMDYEDFKYCWENFVYNDNEPFKPWKGLKTNERLLKRRLRESLQ (italic: nucleic acid editing domain)

Gorilla APOBEC3C
(SEQ ID NO: 45)
MNPQIRNPMKAMYPGTFYFQFKNLWEANDRNETWLCFTVEGIKRRSVVSWKTGVFRNQVDSETH*CHAE*
*RCFLSWECDDILSPNTNYQVTWYTSWSPCPE*CAGEVAEFLARHSNVNLTIFTARLYYFQDTDYQEGLR
SLSQEGVAVKIMDYKDFKYCWENFVYNDDEPFKPWKGLKYNFRFLKRRLQEILE (italic: nucleic acid editing domain)

Human APOBEC-3A:
(SEQ ID NO: 46)
MEASPASGPRHLMDPHIFTSNFNNGIGRHKTYLCYEVERLDNGTSVKMDQHRGFLHNQAKNLLCGFYG
R*HAELRFLDLVPSLQLDPAQIYRVTWFISWSPCFSWGC*AGEVRAFLQENTHVRLRIFAARIYDYDPLY
KEALQMLRDAGAQVSIMTYDEFKHCWDTFVDHQGCPFQPWDGLDEHSQALSGRLRAILQNQGN (italic: nucleic acid editing domain)

Rhesus macaque APOBEC-3A:
(SEQ ID NO: 47)
MDGSPASRPRHLMDPNTFTENFNNDLSVRGRHQTYLCYEVERLDNGTWVPMDERRGFLCNKAKNVPCG
DYGC*HVELRFLCEVPSWOLDPAQTYRVTWFISWSPC*FRRGCAGQVRVFLQENKHVRLRIFAARIYDYD
PLYQEALRTLRDAGAQVSIMTYEEFKHCWDTFVDRQGRPFQPWDGLDEHSQALSGRLRAILQNQGN (italic: nucleic acid editing domain)

Bovine APOBEC-3A:
(SEQ ID NO: 48)
MDEYTFTENFNNQGWPSKTYLCYEMERLDGDATIPLDEYKGFVRNKGLDQPEKPC*HAELYFLGKIHSW*
*NLDRNQHYRLTCFISWSPC*YDCAQKLTTFLKENHHISLHILASRIYTHNRFGCHQSGLCELQAAGARI
TIMTFEDFKHCWETFVDHKGKPFQPWEGLNVKSQALCTELQAILKTOON (italic: nucleic acid editing domain)

Human APOBEC-3H:
(SEQ ID NO: 49)
MALLTAETFRLQFNNKRRLRRPYYPRKALLCYQLTPQNGSTPTRGYFENKKKC*HAEICFINEIKSMGL
DETQCYQVTCYLTWSPCSSC*AWELVDFIKAHDHLNLGIFASRLYYHWCKPQQKGLRLLCGSQVPVEVM
GFPKFADCWENFVDHEKPLSFNPYKMLEELDKNSRAIKRRLERIKIPGVRAQGRYMDILCDAEV (italic: nucleic acid editing domain)

Rhesus macaque APOBEC-3H:
(SEQ ID NO: 50)
MALLTAKTFSLQFNNKRRVNKPYYPRKALLCYQLTPQNGSTPTRGHLKNKKKDHAEIRFINKIKSMGL
DETQCYQVTCYLTWSPCPSCAGELVDFIKAHRHLNLRIFASRLYYHWRPNYQEGLLLLCGSQVPVEVM
GLPEFTDCWENFVDHKEPPSENPSEKLEELDKNSQAIKRRLERIKSRSVDVLENGLRSLQLGPVTPSS
SIRNSR Human APOBEC-3D:
(SEQ ID NO: 51)
MNPQIRNPMERMYRDTFYDNFENEPILYGRSYTWLCYEVKIKRGRSNLLWDTGVFRGPVLPKRQSNHR
QEVYFRFEN*HAEMCFLSWFCGNRLPANRRFQITWFVSWNPC*LPCVVKVTKFLAEHPNVTLTISAARLY
YYRDRDWRWVLLRLHKAGARVKIMDYEDFAYCWENFVCNEGQPFMPWYKFDDNYASLHRTLKEILRNP
MEAMYPHIFYFHFKNLLKACGRNESWLCFTMEVTKHHSAVFRKRGVFRNQVDPETH*CHAERCFLSWFC*

-continued

*DDILSPNTNYEVTWYTSWSPCPEC*AGEVAEFLARHSNVNLTIFTARLCYFWDTDYQEGLCSLSQEGAS

VKIMGYKDFVSCWKNFVYSDDEPFKPWKGLQTNERLLKRRLREILQ (italic: nucleic acid editing domain)

Human APOBEC-1:
(SEQ ID NO: 52)
MTSEKGPSTGDPTLRRRIEPWEFDVFYDPRELRKEACLLYEIKWGMSRKIWRSSGKNTTNHVEVNFIK

KFTSERDFHPSMSCSITWFLSWSPCWECSQAIREFLSRHPGVTLVIYVARLFWHMDQQNRQGLRDLVN

SGVTIQIMRASEYYHCWRNFVNYPPGDEAHWPQYPPLWMMLYALELHCIILSLPPCLKISRRWQNHLT

FFRLHLQNCHYQTIPPHILLATGLIHPSVAWR

Mouse APOBEC-1:
(SEQ ID NO: 53)
MSSETGPVAVDPTLRRRIEPHEFEVFFDPRELRKETCLLYEINWGGRHSVWRHTSQNTSNHVEVNFLE

KFTTERYFRPNTRCSITWFLSWSPCGECSRAITEFLSRHPYVTLFIYIARLYHHTDQRNRQGLRDLIS

SGVTIQIMTEQEYCYCWRNFVNYPPSNEAYWPRYPHLWVKLYVLELYCIILGLPPCLKILRRKQPQLT

FFTITLQTCHYQRIPPHLLWATGLK

Rat APOBEC-1:
(SEQ ID NO: 54)
MSSETGPVAVDPTLRRRIEPHEFEVFFDPRELRKETCLLYEINWGGRHSIWRHTSQNTNKHVEVNFIE

KFTTERYFCPNTRCSITWFLSWSPCGECSRAITEFLSRYPHVTLFIYIARLYHHADPRNRQGLRDLIS

SGVTIQIMTEQESGYCWRNFVNYSPSNEAHWPRYPHLWVRLYVLELYCIILGLPPCLNILRRKQPQLT

FFTIALQSCHYQRLPPHILWATGLK

Human APOBEC-2:
(SEQ ID NO: 55)
MAQKEEAAVATEAASQNGEDLENLDDPEKLKELIELPPFEIVTGERLPANFFKFQFRNVEYSSGRNKT

FLCYVVEAQGKGGQVQASRGYLEDEHAAAHAEEAFFNTILPAFDPALRYNVTWYVSSSPCAACADRII

KTLSKTKNLRLLILVGRLFMWEEPEIQAALKKLKEAGCKLRIMKPQDFEYVWQNFVEQEEGESKAFQP

WEDIQENFLYYEEKLADILK

Mouse APOBEC-2:
(SEQ ID NO: 56)
MAQKEEAAEAAAPASQNGDDLENLEDPEKLKELIDLPPFEIVTGVRLPVNFFKFQFRNVEYSSGRNKT

FLCYVVEVQSKGGQAQATQGYLEDEHAGAHAEEAFFNTILPAFDPALKYNVTWYVSSSPCAACADRIL

KTLSKTKNLRLLILVSRLFMWEEPEVQAALKKLKEAGCKLRIMKPQDFEYIWQNFVEQEEGESKAFEP

WEDIQENFLYYEEKLADILK

Rat APOBEC-2:
(SEQ ID NO: 57)
MAQKEEAAEAAAPASQNGDDLENLEDPEKLKELIDLPPFEIVTGVRLPVNFFKFQFRNVEYSSGRNKT

FLCYVVEAQSKGGQVQATQGYLEDEHAGAHAEEAFENTILPAFDPALKYNVTWYVSSSPCAACADRIL

KTLSKTKNLRLLILVSRLFMWEEPEVQAALKKLKEAGCKLRIMKPQDFEYLWQNFVEQEEGESKAFEP

WEDIQENFLYYEEKLADILK

Bovine APOBEC-2:
(SEQ ID NO: 58)
MAQKEEAAAAAEPASQNGEEVENLEDPEKLKELIELPPFEIVTGERLPAHYFKFQFRNVEYSSGRNKT

FLCYVVEAQSKGGQVQASRGYLEDEHATNHAEEAFFNSIMPTEDPALRYMVTWYVSSSPCAACADRIV

KTLNKTKNLRLLILVGRLFMWEEPEIQAALRKLKEAGCRLRIMKPQDFEYIWQNFVEQEEGESKAFEP

WEDIQENFLYYEEKLADILK

Petromyzon marinus CDA1 (pmCDA1)
(SEQ ID NO: 59)
MTDAEYVRIHEKLDIYTFKKQFFNNKKSVSHRCYVLFELKRRGERRACFWGYAVNKPQSGTERGIHAE

IFSIRKVEEYLRDNPGQFTINWYSSWSPCADCAEKILEWYNQELRGNGHTLKIWACKLYYEKNARNQI

GLWNLRDNGVGLNVMVSEHYQCCRKIFIQSSHNQLNENRWLEKTLKRAEKRRSELSFMIQVKILHTTK

SPAV

Human APOBEC3G D316R D317R
(SEQ ID NO: 60)
MKPHFRNTVERMYRDTFSYNFYNRPILSRRNTVWLCYEVKTKGPSRPPLDAKIFRGQVYSELKYHPEM

RFFHWFSKWRKLHRDQEYEVTWYISWSPCTKCTRDMATFLAEDPKVTLTIFVARLYYFWDPDYQEALR

SLCQKRDGPRATMKENYDEFQHCWSKFVYSQRELFEPWNNLPKYYILLHFMLGEILRHSMDPPTFTEN

FNNEPWVRGRHETYLCYEVERMHNDTWVLLNQRRGFLCNQAPHKHGFLEGRHAELCFLDVIPFWKLDL

DQDYRVTC

FTSWSPCFSCAQEMAKFISKKHVSLCIFTARIYRRQGRCQEGLRTLAEAGAKISFTYSEFKHCWDTFV

DHQGCPFQPWDGLDEHSQDLSGRLRAILQNQEN

Human APOBEC3G chain A
(SEQ ID NO: 61)
MDPPTFTENENNEPWWGRHETYLCYEVERMHNDTWVLLNQRRGFLCNQAPHKHGFLEGRHAELCFLDV

IPFWKLDLDQDYRVTCFTSWSPCFSCAQEMAKFISKNKHVSLCIFTARIYDDQGRCQEGLRTLAEAGA

KISFTYSEFKHCWDTFVDHQGCPFQPWDGLDEHSQDLSGRLRAILQ

Human APOBEC3G chain A D120R D121R
(SEQ ID NO: 62)
MDPPTFTFNFNNEPWVRGRHETYLCYEVERMHNDTWVLLNQRRGFLCNQAPHKHGFLEGRHAELCELD

VIPFWKLDLDQDYRVTCFTSWSPCFSCAQEMAKFISKNKHVSLCIFTARIYRRQGRCQEGLRTLAEAG

AKISFMTYSEFKHCWDTFVDHQGCPFQPWDGLDEHSQDLSGRLRAILQ

The term "deaminase" or "deaminase domain" refers to a protein or fragment thereof that catalyzes a deamination reaction.

"Detect" refers to identifying the presence, absence or amount of the analyte to be detected. In one embodiment, a sequence alteration in a polynucleotide or polypeptide is detected. In another embodiment, the presence of indels is detected.

By "detectable label" is meant a composition that when linked to a molecule of interest renders the latter detectable, via spectroscopic, photochemical, biochemical, immunochemical, or chemical means. For example, useful labels include radioactive isotopes, magnetic beads, metallic beads, colloidal particles, fluorescent dyes, electron-dense reagents, enzymes (for example, as commonly used in an ELISA), biotin, digoxigenin, or haptens.

By "disease" is meant any condition or disorder that damages or interferes with the normal function of a cell, tissue, or organ. In particular embodiments, a disease amenable to treatment with compositions of the invention is associated with a point mutation, a splicing event, a premature stop codon, or a misfolding event.

By "DNA binding protein domain" is meant a polypeptide or fragment thereof that binds DNA. In some embodiments, the DNA binding protein domain is a Zinc Finger or TALE domain having sequence specific DNA binding activity. In other embodiments, the DNA binding protein domain is a domain of a CRISPR-Cas protein (e.g., Cas9) that binds DNA, including, for example, that binds a protospacer adjacent motif (PAM). In some embodiments, the DNA binding protein domain forms a complex with a polynucleotide (e.g., single-guide RNA), and the complex binds DNA sequences specified by a gRNA and a protospacer adjacent motif. In some embodiments, the DNA binding protein domain comprises nickase activity (e.g., nCas9) or is catalytically inactive (e.g., dCas9, Zinc finger domain, TALE). In still other embodiments, the DNA binding protein domain is a catalytically inactive variant of the homing endonuclease I-SceI or the DNA-binding domain of the TALE protein AvrBs4. See, for example, Gabsalilow et al., Nucleic Acids Research, Volume 41, Issue 7, 1 Apr. 2013, Pages e83. In some embodiments, a DNA binding protein domain is fused to a domain having catalytic activity (e.g., FokI, MutH). In particular embodiments, a Zinc finger domain is fused to a catalytic domain of the endonuclease FokI. In other embodiments, a TALE is fused to MutH, which comprises site-specific DNA nicking activity.

The term "effective amount," as used herein, refers to an amount of a biologically active agent that is sufficient to elicit a desired biological response. In particular embodiments, an effective amount is the amount of two or more plasmids comprising portions of a base editor system that are sufficient to express an active base editing system in a cell transfected with the plasmids. As will be appreciated by the skilled artisan, the effective amount of an agent, e.g., a fusion protein may vary depending on various factors as, for example, on the desired biological response, e.g., on the specific allele, genome, or target site to be edited, on the cell or tissue being targeted, and on the agent being used.

By "fragment" is meant a portion of a polypeptide or nucleic acid molecule. This portion contains, at least about 10%, 20%, 30%, 40%, 50%, 60%, 70%, 80%, or 90% of the entire length of the reference nucleic acid molecule or polypeptide. A fragment may contain 10, 20, 30, 40, 50, 60, 70, 80, 90, or 100, 200, 300, 400, 500, 600, 700, 800, 900, or 1000 nucleotides or amino acids.

"Hybridization" means hydrogen bonding, which may be Watson-Crick, Hoogsteen or reversed Hoogsteen hydrogen bonding, between complementary nucleobases. For example, adenine and thymine are complementary nucleobases that pair through the formation of hydrogen bonds.

The term "inhibitor of base repair" or "IBR" refers to a protein that is capable in inhibiting the activity of a nucleic acid repair enzyme, for example a base excision repair enzyme. In some embodiments, the IBR is an inhibitor of inosine base excision repair. Exemplary inhibitors of base repair include inhibitors of APE1, Endo III, Endo IV, Endo V, Endo VIII, Fpg, hOGGI, hNEIL1, T7 EndoI, T4PDG, UDG, hSMUGI, and hAAG. In some embodiments, the IBR is an inhibitor of Endo V or hAAG. In some embodiments, the IBR is a catalytically inactive EndoV or a catalytically inactive hAAG.

An "intein" is a fragment of a protein that is able to excise itself and join the remaining fragments (the exteins) with a peptide bond in a process known as protein splicing. Inteins are also referred to as "protein introns." The process of an intein excising itself and joining the remaining portions of the protein is herein termed "protein splicing" or "intein-mediated protein splicing." In some embodiments, an intein of a precursor protein (an intein containing protein prior to intein-mediated protein splicing) comes from two genes. Such intein is referred to herein as a split intein (e.g., split intein-N and split intein-C). For example, in cyanobacteria, DnaE, the catalytic subunit a of DNA polymerase III, is encoded by two separate genes, dnaE-n and dnaE-c. The intein encoded by the dnaE-n gene may be herein referred as "intein-N." The intein encoded by the dnaE-c gene may be herein referred as "intein-C."

Other intein systems may also be used. For example, a synthetic intein based on the dnaE intein, the Cfa-N(e.g., split intein-N) and Cfa-C(e.g., split intein-C) intein pair, has been described (e.g., in Stevens et al., J Am Chem Soc. 2016 Feb. 24; 138 (7): 2162-5, incorporated herein by reference). Non-limiting examples of intein pairs that may be used in accordance with the present disclosure include: Cfa DnaE intein, Ssp GyrB intein, Ssp DnaX intein, Ter DnaE3 intein, Ter ThyX intein, Rma DnaB intein and Cne Prp8 intein (e.g., as described in U.S. Pat. No. 8,394,604, incorporated herein by reference).

Exemplary nucleotide and amino acid sequences of inteins are provided.

DnaE Intein-N DNA:
(SEQ ID NO: 63)
TGCCTGTCATACGAAACCGAGATACTGACAGTAGAATATGGCCTTCTGCC

AATCGGGAAGATTGTGGAGAAACGGATAGAATGCACAGTTTACTCTGTCG

ATAACAATGGTAACATTTATACTCAGCCAGTTGCCCAGTGGCACGACCGG

GGAGAGCAGGAAGTATTCGAATACTGTCTGGAGGATGGAAGTCTCATTAG

GGCCACTAAGGACCACAAATTTATGACAGTCGATGGCCAGATGCTGCCTA

TAGACGAAATCTTTGAGCGAGAGTTGGACCTCATGCGAGTTGACAACCTT

CCTAAT

DnaE Intein-N Protein:
(SEQ ID NO: 64)
CLSYETEILTVEYGLLPIGKIVEKRIECTVYSVDNNGNIYTQPVAQWHDR

GEQEVFEYCLEDGSLIRATKDHKFMTVDGQMLPIDEIFERELDLMRVDNL

PN

DnaE Intein-C DNA:
(SEQ ID NO: 65)
ATGATCAAGATAGCTACAAGGAAGTATCTTGGCAAACAAAACGTTTATGA

TATTGGAGTCGAAAGAGATCACAACTTTGCTCTGAAGAACGGATTCATAG

CTTCTAAT

Intein-C:
(SEQ ID NO: 66)
MIKIATRKYLGKQNVYDIGVERDHNFALKNGFIASN

Cfa-N DNA:
(SEQ ID NO: 67)
TGCCTGTCTTATGATACCGAGATACTTACCGTTGAATATGGCTTCTTGCC

TATTGGAAAGATTGTCGAAGAGAGAATTGAATGCACAGTATATACTGTAG

ACAAGAATGGTTTCGTTTACACACAGCCCATTGCTCAATGGCACAATCGC

GGCGAACAAGAAGTATTTGAGTACTGTCTCGAGGATGGAAGCATCATACG

AGCAACTAAAGATCATAAATTCATGACCACTGACGGGCAGATGTTGCCAA

TAGATGAGATATTCGAGCGGGGCTTGGATCTCAAACAAGTGGATGGATTG

CCA

Cfa-N Protein:
(SEQ ID NO: 68)
CLSYDTEILTVEYGFLPIGKIVEERIECTVYTVDKNGFVYTQPIAQWHNR

GEQEVFEYCLEDGSIIRATKDHKFMTTDGQMLPIDEIFERGLDLKQVDGL

P

Cfa-C DNA:
(SEQ ID NO: 69)
ATGAAGAGGACTGCCGATGGATCAGAGTTTGAATCTCCCAAGAAGAAGAG

GAAAGTAAAGATAATATCTCGAAAAAGTCTTGGTACCCAAAATGTCTATG

ATATTGGAGTGGAGAAAGATCACAACTTCCTTCTCAAGAACGGTCTCGTA

GCCAGCAAC

Cfa-C Protein:
(SEQ ID NO: 70)
MKRTADGSEFESPKKKRKVKIISRKSLGTQNVYDIGVEKDHNFLLKNGLV

ASN

Intein-N and intein-C may be fused to the N-terminal portion of the split Cas9 and the C-terminal portion of the split Cas9, respectively, for the joining of the N-terminal portion of the split Cas9 and the C-terminal portion of the split Cas9. For example, in some embodiments, an intein-N is fused to the C-terminus of the N-terminal portion of the split Cas9, i.e., to form a structure of N--[N-terminal portion of the split Cas9]-[intein-N]--C. In some embodiments, an intein-C is fused to the N-terminus of the C-terminal portion of the split Cas9, i.e., to form a structure of N-[intein-C]--[C-terminal portion of the split Cas9]-C. The mechanism of intein-mediated protein splicing for joining the proteins the inteins are fused to (e.g., split Cas9) is known in the art, e.g., as described in Shah et al., Chem Sci. 2014; 5 (1): 446-461, incorporated herein by reference. Methods for designing and using inteins are known in the art and described, for example by WO2014004336, WO2017132580, US20150344549, and US20180127780, each of which is incorporated herein by reference in their entirety.

The terms "isolated," "purified," or "biologically pure" refer to material that is free to varying degrees from components which normally accompany it as found in its native state. "Isolate" denotes a degree of separation from original source or surroundings. "Purify" denotes a degree of separation that is higher than isolation. A "purified" or "biologically pure" protein is sufficiently free of other materials such that any impurities do not materially affect the biological properties of the protein or cause other adverse consequences. That is, a nucleic acid or peptide of this invention is purified if it is substantially free of cellular material, viral material, or culture medium when produced by recombinant DNA techniques, or chemical precursors or other chemicals when chemically synthesized. Purity and homogeneity are typically determined using analytical chemistry techniques, for example, polyacrylamide gel electrophoresis or high performance liquid chromatography. The term "purified" can denote that a nucleic acid or protein gives rise to essentially one band in an electrophoretic gel. For a protein that can be subjected to modifications, for example, phosphorylation or glycosylation, different modifications may give rise to different isolated proteins, which can be separately purified.

By "isolated polynucleotide" is meant a nucleic acid (e.g., a DNA) that is free of the genes which, in the naturally-occurring genome of the organism from which the nucleic acid molecule of the invention is derived, flank the gene. The term therefore includes, for example, a recombinant DNA that is incorporated into a vector; into an autonomously replicating plasmid or virus; or into the genomic DNA of a prokaryote or eukaryote; or that exists as a separate molecule (for example, a cDNA or a genomic or cDNA fragment produced by PCR or restriction endonuclease digestion) independent of other sequences. In addition, the term includes an RNA molecule that is transcribed from a DNA molecule, as well as a recombinant DNA that is part of a hybrid gene encoding additional polypeptide sequence.

By an "isolated polypeptide" is meant a polypeptide of the invention that has been separated from components that naturally accompany it. Typically, the polypeptide is isolated when it is at least 60%, by weight, free from the proteins and naturally-occurring organic molecules with which it is naturally associated. Preferably, the preparation is at least 75%, more preferably at least 90%, and most preferably at least 99%, by weight, a polypeptide of the invention. An isolated polypeptide of the invention may be obtained, for example, by extraction from a natural source, by expression of a recombinant nucleic acid encoding such a polypeptide; or by chemically synthesizing the protein. Purity can be measured by any appropriate method, for example, column chromatography, polyacrylamide gel electrophoresis, or by HPLC analysis.

The term "linker," as used herein, refers to a bond (e.g., covalent bond), chemical group, or a molecule linking two molecules or moieties, e.g., two domains of a fusion protein. In some embodiments, a linker joins a gRNA binding domain of an RNA-programmable nuclease, including a Cas9 nuclease domain, and the catalytic domain of a nucleic-acid editing protein. In some embodiments, a linker joins a dCas9 and a nucleic-acid editing protein. Typically, the linker is positioned between, or flanked by, two groups, molecules, or other moieties and connected to each one via a covalent bond, thus connecting the two. In some embodiments, the linker is an amino acid or a plurality of amino acids (e.g., a peptide or protein). In some embodiments, the linker is an organic molecule, group, polymer, or chemical moiety. In some embodiments, the linker is 5-200 amino acids in length, for example, 5, 6, 7, 8, 9, 10, 11, 12, 13, 14, 15, 16, 17, 18, 19, 20, 25, 35, 45, 50, 55, 60, 60, 65, 70, 70, 75, 80, 85, 90, 90, 95, 100, 101, 102, 103, 104, 105, 110, 120, 130, 140, 150, 160, 175, 180, 190, or 200 amino acids in length. Longer or shorter linkers are also contemplated. In some embodiments, a linker comprises the amino acid sequence SGSETPGTSESATPES (SEQ ID NO: 71), which may also be referred to as the XTEN linker. In some embodiments, a linker comprises the amino acid sequence SGGS (SEQ ID NO: 78). In some embodiments, a linker comprises (SGGS)$_n$ (SEQ ID NO: 72), (GGGS)$_n$ (SEQ ID NO: 73), (GGGGS)$_n$ (SEQ ID NO: 74), (G)$_n$ (SEQ ID NO: 75), (EAAAK), (SEQ ID NO: 76), (GGS)$_n$ (SEQ ID NO: 77), SGSETPGTSESATPES (SEQ ID NO: 71), or (XP)$_n$ motif (SEQ ID NO: 79), or a combination of any of these, wherein n is independently an integer between 1 and 30, and wherein X is any amino acid. In some embodiments, n is 1, 2, 3, 4, 5, 6, 7, 8, 9, 10, 11, 12, 13, 14, or 15.

In some embodiments, the domains of the nucleobase editor are fused via a linker that comprises the amino acid sequence of SGGSSGSETPGTSESATPESSGGS (SEQ ID NO: 80), SGGSSGGSSGSETPGTSESATPESSGGSSGGS (SEQ ID NO: 81), or GGSGGSPGSPAGSPTSTEEGTSESATPESGPGTSTEPSEGSAPGSPAGSPTSTEEGTSTEPSEGSAPGTSTEPSEGSAPGTSESATPESGPGSEPATSGGSGGS (SEQ ID NO: 82). In some embodiments, domains of the nucleobase editor are fused via a linker comprising the amino acid sequence SGSETPGTSESATPES (SEQ ID NO: 71), which may also be referred to as the XTEN linker. In some embodiments, the linker is 24 amino acids in length. In some embodiments, the linker comprises the amino acid sequence SGGSSGGSSGSETPGTSESATPES (SEQ ID NO: 83). In some embodiments, the linker is 40 amino acids in length. In some embodiments, the linker comprises the amino acid sequence SGGSSGGSSGSETPGTSESATPESSGGSSGGSSGGSSGGS (SEQ ID NO: 84). In some embodiments, the linker is 64 amino acids in length. In some embodiments, the linker comprises the amino acid sequence SGGSSGGSSGSETPGTSESATPESSGGSSGGSSGGSSGGSSGGSSGSETPGTSESATPESSGGS SGGS (SEQ ID NO: 85). In some embodiments, the linker is 92 amino acids in length. In some embodiments, the linker comprises the amino acid sequence PGSPAGSPTSTEEGTSESATPESGPGTSTEPSEGSAPGSPAGSPTSTEEGTSTEPSEGSAP GTSTEPSEGSAPGTSESATPESGPGSEPATS (SEQ ID NO: 86).

By "marker" is meant any protein or polynucleotide having an alteration in expression level or activity that is associated with a disease or disorder.

The term "mutation," as used herein, refers to a substitution of a residue within a sequence, e.g., a nucleic acid or amino acid sequence, with another residue, or a deletion or insertion of one or more residues within a sequence. Mutations are typically described herein by identifying the original residue followed by the position of the residue within the sequence and by the identity of the newly substituted residue. Various methods for making the amino acid substitutions (mutations) provided herein are well known in the art, and are provided by, for example, Green and Sambrook, *Molecular Cloning: A Laboratory Manual* (4th ed., Cold Spring Harbor Laboratory Press, Cold Spring Harbor, N.Y. (2012)).

The terms "nucleic acid" and "nucleic acid molecule," as used herein, refer to a compound comprising a nucleobase and an acidic moiety, e.g., a nucleoside, a nucleotide, or a polymer of nucleotides. Typically, polymeric nucleic acids, e.g., nucleic acid molecules comprising three or more nucleotides are linear molecules, in which adjacent nucleotides are linked to each other via a phosphodiester linkage. In some embodiments, "nucleic acid" refers to individual nucleic acid residues (e.g. nucleotides and/or nucleosides). In some embodiments, "nucleic acid" refers to an oligonucleotide chain comprising three or more individual nucleotide residues. As used herein, the terms "oligonucleotide" and "polynucleotide" can be used interchangeably to refer to a polymer of nucleotides (e.g., a string of at least three nucleotides). In some embodiments, "nucleic acid" encompasses RNA as well as single and/or double-stranded DNA. Nucleic acids may be naturally occurring, for example, in the context of a genome, a transcript, an mRNA, tRNA, IRNA, siRNA, snRNA, a plasmid, cosmid, chromosome, chromatid, or other naturally occurring nucleic acid molecule. On the other hand, a nucleic acid molecule may be a non-naturally occurring molecule, e.g., a recombinant DNA or RNA, an artificial chromosome, an engineered genome, or fragment thereof, or a synthetic DNA, RNA, DNA/RNA hybrid, or including non-naturally occurring nucleotides or nucleosides. Furthermore, the terms "nucleic acid," "DNA," "RNA," and/or similar terms include nucleic acid analogs, e.g., analogs having other than a phosphodiester backbone. Nucleic acids can be purified from natural sources, produced using recombinant expression systems and optionally purified, chemically synthesized, etc. Where appropriate, e.g., in the case of chemically synthesized molecules, nucleic acids can comprise nucleoside analogs such as analogs having chemically modified bases or sugars, and backbone modifications. A nucleic acid sequence is presented in the 5' to 3' direction unless otherwise indicated. In some embodiments, a nucleic acid is or comprises natural nucleosides (e.g. adenosine, thymidine, guanosine, cytidine, uridine, deoxyadenosine, deoxythymidine, deoxyguanosine, and deoxycytidine); nucleoside analogs (e.g., 2-aminoadenosine, 2-thiothymidine, inosine, pyrrolo-pyrimidine, 3-methyl adenosine, 5-methylcytidine, 2-aminoadenosine, C5-bromouridine, C5-fluorouridine, C5-iodouridine, C5-propynyl-uridine, C5-propynyl-cytidine, C5-methylcytidine, 2-aminoadenosine, 7-deazaadenosine, 7-deazaguanosine, 8-oxoadenosine, 8-oxoguanosine, O (6)-methylguanine, and 2-thiocytidine); chemically modified bases; biologically modified bases (e.g., methylated bases); intercalated bases; modified sugars (2'-e.g., fluororibose, ribose, 2'-deoxyribose, arabinose, and hexose); and/or modified phosphate groups (e.g., phosphorothioates and 5'-N-phosphoramidite linkages).

The term "nuclear localization sequence," "nuclear localization signal," or "NLS" refers to an amino acid sequence that promotes import of a protein into the cell nucleus. Nuclear localization sequences are known in the art and described, for example, in Plank et al., International PCT application, PCT/EP2000/011690, filed Nov. 23, 2000, published as WO/2001/038547 on May 31, 2001, the contents of which are incorporated herein by reference for their disclosure of exemplary nuclear localization sequences. In other embodiments, the NLS is an optimized NLS described, for example, by Koblan et al., Nature Biotech. 2018 doi: 10.1038/nbt.4172. In some embodiments, an NLS comprises the amino acid sequence KRTADGSEFESPKKKRKV (SEQ ID NO: 87), KRPAATKKAGQAKKKK (SEQ ID NO: 88), KKTELQTTNAENKTKKL (SEQ ID NO: 89), KRGINDRNFWRGENGRKTR (SEQ ID NO: 90), RKSGKIAAIV-VKRPRK (SEQ ID NO: 91), PKKKRKV (SEQ ID NO: 92), or MDSLLMNRRKFLYQFKNVRWAKGRRETYLC (SEQ ID NO: 93).

The term "nucleic acid programmable DNA binding protein" or "napDNAbp" refers to a protein that associates with a nucleic acid (e.g., DNA or RNA), such as a guide nucleic acid, that guides the napDNAbp to a specific nucleic acid sequence. For example, a Cas9 protein can associate with a guide RNA that guides the Cas9 protein to a specific DNA sequence that is complementary to the guide RNA. In some embodiments, the napDNAbp is a Cas9 domain, for example a nuclease active Cas9, a Cas9 nickase (nCas9), or a nuclease inactive Cas9 (dCas9). Examples of nucleic acid programmable DNA binding proteins include, without limitation, Cas9 (e.g., dCas9 and nCas9), CasX, CasY, Cpf1, C2c1, and C2c3. Other nucleic acid programmable DNA binding proteins are also within the scope of this disclosure, although they may not be specifically listed in this disclosure. As used herein, "obtaining" as in "obtaining an agent" includes synthesizing, purchasing, or otherwise acquiring the agent.

"Patient" or "subject" as used herein refers to a subject, e,g, a mammalian subject diagnosed with or suspected of having or developing a disease or a disorder. In some embodiments, the term "patient" refers to a mammalian subject with a higher than average likelihood of developing a disease or a disorder. Exemplary patients can be humans, non-human primates, cats, dogs, pigs, cattle, cats, horses, goats, sheep, rodents (e.g., mice, rabbits, rats, or guinea pigs) and other mammalians that can benefit from the therapies disclosed herein. Exemplary human patients can be male and/or female. "Patient in need thereof" or "subject in need thereof" is referred to herein as a patient diagnosed with or suspected of having a disease or disorder.

The term "RNA-programmable nuclease," and "RNA-guided nuclease" are used with (e.g., binds or associates with) one or more RNA(s) that is not a target for cleavage. In some embodiments, an RNA-programmable nuclease, when in a complex with an RNA, may be referred to as a nuclease: RNA complex. Typically, the bound RNA(s) is referred to as a guide RNA (gRNA). gRNAs can exist as a complex of two or more RNAs, or as a single RNA molecule. gRNAs that exist as a single RNA molecule may be referred to as single-guide RNAs (sgRNAs), though "gRNA" is used interchangeably to refer to guide RNAs that exist as either single molecules or as a complex of two or more molecules. Typically, gRNAs that exist as single RNA species comprise two domains: (1) a domain that shares homology to a target nucleic acid (e.g., and directs binding of a Cas9 complex to the target); and (2) a domain that binds a Cas9 protein. In some embodiments, domain (2) corresponds to a sequence known as a tracrRNA, and comprises a stem-loop structure. For example, in some embodiments, domain (2) is identical or homologous to a tracrRNA as provided in Jinek et ah, Science 337:816-821 (2012), the entire contents of which is incorporated herein by reference. Other examples of gRNAs (e.g., those including domain 2) can be found in U.S. Provisional Patent Application, U.S. Ser. No. 61/874,682, filed Sep. 6, 2013, entitled "Switchable Cas9 Nucleases And Uses Thereof," and U.S. Provisional Patent Application, U.S. Ser. No. 61/874,746, filed Sep. 6, 2013, entitled "Delivery System For Functional Nucleases," the entire contents of each are hereby incorporated by reference in their entirety. In some embodiments, a gRNA comprises two or more of domains (1) and (2), and may be referred to as an "extended gRNA." For example, an extended gRNA will, e.g., bind two or more Cas9 proteins and bind a target nucleic acid at two or more distinct regions, as described herein. The gRNA comprises a nucleotide sequence that complements a target site, which mediates binding of the nuclease/RNA complex to said target site, providing the sequence specificity of the nuclease: RNA complex. In some embodiments, the RNA-programmable nuclease is the (CRIS PR-associated system) Cas9 endonuclease, for example, Cas9 (Csn1) from *Streptococcus pyogenes* (see, e.g., "Complete genome sequence of an M1 strain of *Streptococcus pyogenes*." Ferretti J. J., McShan W. M., Ajdic D.J., Savic D.J., Savic G., Lyon K., Primeaux C, Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., Proc. Natl. Acad. Sci. U.S.A. 98:4658-4663 (2001); "CRISPR RNA maturation by trans-encoded small RNA and host factor RNase III." Deltcheva E., Chylinski K., Sharma C M., Gonzales K., Chao Y., Pirzada Z. A., Eckert M. R., Vogel J., Charpentier E., Nature 471:602-607 (2011).

The term "recombinant" as used herein in the context of proteins or nucleic acids refers to proteins or nucleic acids that do not occur in nature, but are the product of human engineering. For example, in some embodiments, a recombinant protein or nucleic acid molecule comprises an amino acid or nucleotide sequence that comprises at least one, at least two, at least three, at least four, at least five, at least six, or at least seven mutations as compared to any naturally occurring sequence.

By "reduces" is meant a negative alteration of at least 10%, 25%, 50%, 75%, or 100%.

By "reference" is meant a standard or control condition. In one embodiment, a reference is the activity of a full length nucleobase editor expressed in a single plasmid in the same cells and under the same conditions as a nucleobase editor expressed in fragments comprising inteins for intein-dependent re-assembly.

A "reference sequence" is a defined sequence used as a basis for sequence comparison. A reference sequence may be a subset of or the entirety of a specified sequence; for example, a segment of a full-length cDNA or gene sequence, or the complete cDNA or gene sequence. For polypeptides, the length of the reference polypeptide sequence will generally be at least about 16 amino acids, at least about 20 amino acids, more at least about 25 amino acids, and even more preferably about 35 amino acids, about 50 amino acids, or about 100 amino acids. For nucleic acids, the length of the reference nucleic acid sequence will generally be at least about 50 nucleotides, at least about 60 nucleotides, at least about 75 nucleotides, and about 100 nucleotides or about 300 nucleotides or any integer thereabout or therebetween.

The term "single nucleotide polymorphism (SNP)" is a variation in a single nucleotide that occurs at a specific position in the genome, where each variation is present to some appreciable degree within a population (e.g., >1%). For example, at a specific base position in the human genome, the C nucleotide can appear in most individuals, but in a minority of individuals, the position is occupied by an A. This means that there is a SNP at this specific position, and the two possible nucleotide variations, C or A, are said to be alleles for this position. SNPs underlie differences in susceptibility to disease. The severity of illness and the way our body responds to treatments are also manifestations of genetic variations. SNPs can fall within coding regions of genes, non-coding regions of genes, or in the intergenic regions (regions between genes). In some embodiments, SNPs within a coding sequence do not necessarily change the amino acid sequence of the protein that is produced, due to degeneracy of the genetic code. SNPs in the coding region are of two types: synonymous and nonsynonymous SNPs. Synonymous SNPs do not affect the protein sequence, while nonsynonymous SNPs change the amino acid sequence of protein. The nonsynonymous SNPs are of two types: missense and nonsense. SNPs that are not in protein-coding regions can still affect gene splicing, transcription factor binding, messenger RNA degradation, or the sequence of noncoding RNA. Gene expression affected by this type of SNP is referred to as an eSNP (expression SNP) and can be upstream or downstream from the gene. A single nucleotide variant (SNV) is a variation in a single nucleotide without any limitations of frequency and can arise in somatic cells. A somatic single nucleotide variation can also be called a single-nucleotide alteration.

By "specifically binds" is meant a nucleic acid molecule, polypeptide, or complex thereof (e.g., a nucleic acid programmable DNA binding domain and guide nucleic acid), compound, or molecule that recognizes and binds a polypeptide and/or nucleic acid molecule of the invention, but which does not substantially recognize and bind other molecules in a sample, for example, a biological sample.

Nucleic acid molecules useful in the methods of the invention include any nucleic acid molecule that encodes a polypeptide of the invention or a fragment thereof. Such nucleic acid molecules need not be 100% identical with an endogenous nucleic acid sequence, but will typically exhibit substantial identity. Polynucleotides having "substantial identity" to an endogenous sequence are typically capable of hybridizing with at least one strand of a double-stranded nucleic acid molecule. Nucleic acid molecules useful in the methods of the invention include any nucleic acid molecule that encodes a polypeptide of the invention or a fragment thereof. Such nucleic acid molecules need not be 100% identical with an endogenous nucleic acid sequence, but will typically exhibit substantial identity. Polynucleotides having "substantial identity" to an endogenous sequence are typically capable of hybridizing with at least one strand of a double-stranded nucleic acid molecule. By "hybridize" is meant pair to form a double-stranded molecule between complementary polynucleotide sequences (e.g., a gene described herein), or portions thereof, under various conditions of stringency. (See, e.g., Wahl, G. M. and S. L. Berger (1987) Methods Enzymol. 152:399; Kimmel, A. R. (1987) Methods Enzymol. 152:507).

For example, stringent salt concentration will ordinarily be less than about 750 mM NaCl and 75 mM trisodium citrate, preferably less than about 500 mM NaCl and 50 mM trisodium citrate, and more preferably less than about 250 mM NaCl and 25 mM trisodium citrate. Low stringency hybridization can be obtained in the absence of organic solvent, e.g., formamide, while high stringency hybridization can be obtained in the presence of at least about 35% formamide, and more preferably at least about 50% formamide. Stringent temperature conditions will ordinarily include temperatures of at least about 30° C., more preferably of at least about 37° C., and most preferably of at least about 42° C. Varying additional parameters, such as hybridization time, the concentration of detergent, e.g., sodium dodecyl sulfate (SDS), and the inclusion or exclusion of carrier DNA, are well known to those skilled in the art. Various levels of stringency are accomplished by combining these various conditions as needed. In a one: embodiment, hybridization will occur at 30° C. in 750 mM NaCl, 75 mM trisodium citrate, and 1% SDS. In another embodiment, hybridization will occur at 37° C. in 500 mM NaCl, 50 mM trisodium citrate, 1% SDS, 35% formamide, and 100. µg/ml denatured salmon sperm DNA (ssDNA). In another embodiment, hybridization will occur at 42° C. in 250 mM NaCl, 25 mM trisodium citrate, 1% SDS, 50% formamide, and 200 µg/ml ssDNA. Useful variations on these conditions will be readily apparent to those skilled in the art.

For most applications, washing steps that follow hybridization will also vary in stringency. Wash stringency conditions can be defined by salt concentration and by temperature. As above, wash stringency can be increased by decreasing salt concentration or by increasing temperature. For example, stringent salt concentration for the wash steps will preferably be less than about 30 mM NaCl and 3 mM trisodium citrate, and most preferably less than about 15 mM NaCl and 1.5 mM trisodium citrate. Stringent temperature conditions for the wash steps will ordinarily include a temperature of at least about 25° C., more preferably of at least about 42° C., and even more preferably of at least about 68° C. In an embodiment, wash steps will occur at 25° C. in 30 mM NaCl, 3 mM trisodium citrate, and 0.1% SDS. In a more preferred embodiment, wash steps will occur at 42 C in 15 mM NaCl, 1.5 mM trisodium citrate, and 0.1% SDS. In a more preferred embodiment, wash steps will occur at 68° C. in 15 mM NaCl, 1.5 mM trisodium citrate, and 0.1% SDS. Additional variations on these conditions will be readily apparent to those skilled in the art. Hybridization techniques are well known to those skilled in the art and are described, for example, in Benton and Davis (Science 196: 180, 1977); Grunstein and Hogness (Proc. Natl. Acad. Sci., USA 72:3961, 1975); Ausubel et al. (Current Protocols in Molecular Biology, Wiley Interscience, New York, 2001); Berger and Kimmel (Guide to Molecular Cloning Techniques, 1987, Academic Press, New York); and Sambrook et al., Molecular Cloning: A Laboratory Manual, Cold Spring Harbor Laboratory Press, New York.

By "split" is meant divided into two or more fragments. A "split Cas9 protein" or "split Cas9" refers to a Cas9 protein that is provided as an N-terminal fragment and a C-terminal fragment encoded by two separate nucleotide sequences. The polypeptides corresponding to the N-terminal portion and the C-terminal portion of the Cas9 protein may be spliced to form a "reconstituted" Cas9 protein. In particular embodiments, the Cas9 protein is divided into two fragments within a disordered region of the protein, e.g., as described in Nishimasu et al., Cell, Volume 156, Issue 5, pp. 935-949, 2014, or as described in Jiang et al. (2016) Science 351:867-871. PDB file: 5F9R, each of which is incorporated herein by reference. A disordered region may be determined by one or more protein structure determination techniques known in the art, including without limitation, X-ray crystallography, NMR spectroscopy, electron microscopy (e.g., cryoEM), and/or in silico protein modeling. In some embodiments, the protein is divided into two fragments at any C, T, A, or S within a region of SpCas9 between about amino acids A292-G364, F445-K483, or E565-T637, or at corresponding positions in any other Cas9, Cas9 variant (e.g., nCas9, dCas9), or other napDNAbp. In some embodiments, protein is divided into two fragments at SpCas9 T310, T313, A456, S469, or C574. In some embodiments, the process of dividing the protein into two fragments is referred to as "splitting" the protein.

By "substantially identical" is meant a polypeptide or nucleic acid molecule exhibiting at least 50% identity to a reference amino acid sequence (for example, any one of the amino acid sequences described herein) or nucleic acid sequence (for example, any one of the nucleic acid sequences described herein). In one embodiment, such a sequence is at least 60%, 80% or 85%, 90%, 95% or even 99% identical at the amino acid level or nucleic acid to the sequence used for comparison.

Sequence identity is typically measured using sequence analysis software (for example, Sequence Analysis Software Package of the Genetics Computer Group, University of Wisconsin Biotechnology Center, 1710 University Avenue, Madison, Wis. 53705, BLAST, BESTFIT, GAP, or PILEUP/PRETTYBOX programs). Such software matches identical or similar sequences by assigning degrees of homology to various substitutions, deletions, and/or other modifications. Conservative substitutions typically include substitutions within the following groups: glycine, alanine; valine, isoleucine, leucine; aspartic acid, glutamic acid, asparagine, glutamine; serine, threonine; lysine, arginine; and phenylalanine, tyrosine. In an exemplary approach to determining the degree of identity, a BLAST program may be used, with a probability score between $e^{-3}$ and $e^{-100}$ indicating a closely related sequence.

By "subject" is meant a mammal, including, but not limited to, a human or non-human mammal, such as a bovine, equine, canine, ovine, or feline. Subjects include livestock, domesticated animals raised to produce labor and to provide commodities, such as food, including without limitation, cattle, goats, chickens, horses, pigs, rabbits, and sheep. The term "target site" refers to a sequence within a nucleic acid molecule that is modified by a nucleobase editor. In one embodiment, the target site is deaminated by a deaminase or a fusion protein comprising a deaminase (e.g., cytidine or adenine deaminase).

Because RNA-programmable nucleases (e.g., Cas9) use RNA: DNA hybridization to target DNA cleavage sites, these proteins are able to be targeted, in principle, to any sequence specified by the guide RNA. Methods of using RNA-programmable nucleases, such as Cas9, for site-specific cleavage (e.g., to modify a genome) are known in the art (see e.g., Cong, L. et ah, Multiplex genome engineering using CRISPR/Cas systems. Science 339, 819-823 (2013); Mali, P. et ah, RNA-guided human genome engineering via Cas9. Science 339, 823-826 (2013); Hwang, W. Y. et ah, Efficient genome editing in zebrafish using a CRISPR-Cas system. Nature biotechnology 31, 227-229 (2013); Jinek, M. et ah, RNA-programmed genome editing in human cells. eLife 2, e00471 (2013); Dicarlo, J. E. et ah, Genome engineering in *Saccharomyces cerevisiae* using CRISPR-Cas systems. Nucleic acids research (2013); Jiang, W. et ah RNA-guided editing of bacterial genomes using CRISPR-Cas systems. Nature biotechnology 31, 233-239 (2013); the entire contents of each of which are incorporated herein by reference).

Ranges provided herein are understood to be shorthand for all of the values within the range. For example, a range of 1 to 50 is understood to include any number, combination of numbers, or sub-range from the group consisting 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50.

As used herein, the terms "treat," treating," "treatment," and the like refer to reducing or ameliorating a disorder and/or symptoms associated therewith. It will be appreciated that, although not precluded, treating a disorder or condition does not require that the disorder, condition or symptoms associated therewith be completely eliminated.

The term "uracil glycosylase inhibitor" or "UGI," as used herein, refers to a protein that is capable of inhibiting a uracil-DNA glycosylase base-excision repair enzyme. In some embodiments, a UGI domain comprises a wild-type UGI or a modified version thereof. In some embodiments, the UGI proteins provided herein include fragments of UGI and proteins homologous to a UGI or a UGI fragment. For example, in some embodiments, a UGI domain comprises a fragment of the amino acid sequence set forth herein below. In some embodiments, a UGI fragment comprises an amino acid sequence that comprises at least 60%, at least 65%, at least 70%, at least 75%, at least 80%, at least 85%, at least 90%, at least 95%, at least 96%, at least 97%, at least 98%, at least 99%, or 100% of an exemplary UGI sequence provided herein. In some embodiments, a UGI comprises an amino acid sequence homologous to the amino acid sequence set forth herein below, or an amino acid sequence homologous to a fragment of the amino acid sequence set forth herein below. In some embodiments, proteins comprising UGI or fragments of UGI or homologs of UGI or UGI fragments are referred to as "UGI variants." A UGI variant shares homology to UGI, or a fragment thereof. For example a UGI variant is at least 70% identical, at least 75% identical, at least 80% identical, at least 85% identical, at least 90% identical, at least 95% identical, at least 96% identical, at least 97% identical, at least 98% identical, at least 99% identical, at least 99.5% identical, or at least 99.9% identical to a wild type UGI or a UGI as set forth herein. In some embodiments, the UGI variant comprises a fragment of UGI, such that the fragment is at least 70% identical, at least 80% identical, at least 90% identical, at least 95% identical, at least 96% identical, at least 97% identical, at least 98% identical, at least 99% identical, at least 99.5% identical, or at least 99.9% to the corresponding fragment of wild-type UGI or a UGI as set forth below. In some embodiments, the UGI comprises the following amino acid sequence:

```
>sp|P14739|UNGI_BPPB2 Uracil-DNA glycosylase
inhibitor
                                    (SEQ ID NO: 94)
MTNLSDIIEKETGKQLVIQESILMLPEEVEEVIGNKPESDILVHTAYDES

TDENVMLLT SD APE YKPW ALVIQDS NGENKIKML
```

Unless specifically stated or obvious from context, as used herein, the term "or" is understood to be inclusive. Unless specifically stated or obvious from context, as used herein, the terms "a", "an", and "the" are understood to be singular or plural.

Unless specifically stated or obvious from context, as used herein, the term "about" is understood as within a range of normal tolerance in the art, for example within 2 standard deviations of the mean. About can be understood as within 10%, 9%, 8%, 7%, 6%, 5%, 4%, 3%, 2%, 1%, 0.5%, 0.1%, 0.05%, or 0.01% of the stated value. Unless otherwise clear from context, all numerical values provided herein are modified by the term about.

The recitation of a listing of chemical groups in any definition of a variable herein includes definitions of that variable as any single group or combination of listed groups. The recitation of an embodiment for a variable or aspect herein includes that embodiment as any single embodiment or in combination with any other embodiments or portions thereof. Any compositions or methods provided herein can be combined with one or more of any of the other compositions and methods provided herein.

BRIEF DESCRIPTION OF THE DRAWINGS

In FIG. 4, a 20-nucleotide (nt) guide RNA was used, which included a hammer ribozyme (HRz). The activity of the various reconstituted ABEs was compared to the activity of control ABE7.09 and ABE7.10 fusion proteins.

FIGS. 5A-5D show determination of multiplicity of infection (MOI) for AAV2 co-infection of ARPE-19 cells. FIG. 5A are graphs showing 1:1 coinfections of AAV2/CMV-mCherry and AAV2/CMV-EmGFP at various viral loads (vg/cell). FIG. 5B depicts fluorescence images detecting EmGFP (left) and mCherry (center); and a merged image showing EmGFP and mCherry co-localization (right). FIG. 5C is a graph depicting percentage of cells expressing mCherry at various viral loads (vg/cell), when infected with AAV2/CMV-mCherry. FIG. 5D is a graph depicting percentage of cells expressing EmGFP at various viral loads (vg/cell), when infected with AAV2/EmGFP.

DETAILED DESCRIPTION OF THE INVENTION

Figure 1:
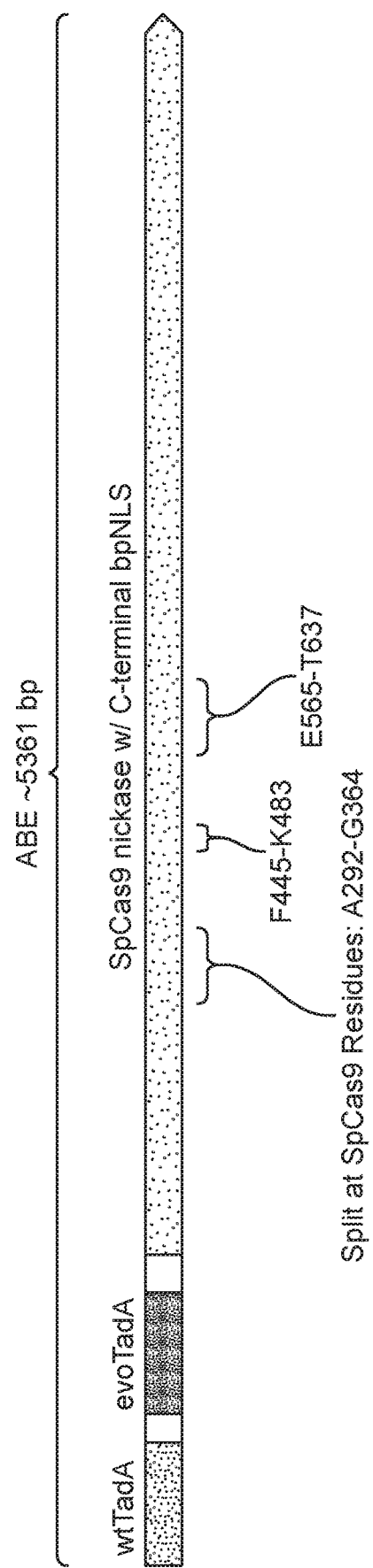
FIG. 1 is a schematic diagram of an A-to-G Base Editor (ABE) fusion protein nucleobase editor comprising two adenosine deaminase domains, wild-type (wt) TadA and an evolved (evo) version of TadA fused to *S. pyogenes* (Sp) Cas9 nickase (nCas9) with a C-terminal bipartite Nuclear Localization Signal (NLS). The schematic also identifies three regions of the Cas9 protein that are unstructured where the fusion protein may be split into N- and C-terminal fragments that can be reconstituted using a split intein system (i.e., fusing an intein-N and an intein-C to the N- and C-terminal fragments, respectively).

As described below, the present invention provides compositions and methods for delivering a base editing system.

The invention is based, at least in part, on the discovery that an A-to-G nucleobase editor (ABE) can be "split" and reconstituted using split inteins. Polynucleotides encoding N- and C-terminal fragments of ABE fused respectively to intein-N and intein-C of a split intein pair and delivered to a cell on separate vectors, together with a single guide RNA. The encoded ABE fragments were spliced together to reconstitute a functional nucleobase editor fusion protein that is useful inter alia for targeted editing of nucleic acid sequences.

Inteins

Inteins (intervening protein) are auto-processing domains found in a variety of diverse organisms, which carry out a process known as protein splicing. Protein splicing is a multi-step biochemical reaction comprised of both the cleavage and formation of peptide bonds.

While the endogenous substrates of protein splicing are proteins found in intein-containing organisms, inteins can also be used to chemically manipulate virtually any polypeptide backbone.

In protein splicing, the intein excises itself out of a precursor polypeptide by cleaving two peptide bonds, thereby ligating the flanking extein (external protein) sequences via the formation of a new peptide bond. This rearrangement occurs post-translationally (or possibly co-translationally). Intein-mediated protein splicing occurs spontaneously, requiring only the folding of the intein domain.

About 5% of inteins are split inteins, which are transcribed and translated as two separate polypeptides, the N-intein and C-intein, each fused to one extein. Upon translation, the intein fragments spontaneously and non-covalently assemble into the canonical intein structure to carry out protein splicing in trans. The mechanism of protein splicing entails a series of acyl-transfer reactions that result in the cleavage of two peptide bonds at the intein-extein junctions and the formation of a new peptide bond between the N- and C-exteins. This process is initiated by activation of the peptide bond joining the N-extein and the N-terminus of the intein. Virtually all inteins have a cysteine or serine at their N-terminus that attacks the carbonyl carbon of the C-terminal N-extein residue. This N to O/S acyl-shift is facilitated by a conserved threonine and histidine (referred to as the TXXH motif), along with a commonly found aspartate, which results in the formation of a linear (thio) ester intermediate. Next, this intermediate is subject to trans-(thio) esterification by nucleophilic attack of the first C-extein residue (+1), which is a cysteine, serine, or threonine. The resulting branched (thio) ester intermediate is resolved through a unique transformation: cyclization of the highly conserved C-terminal asparagine of the intein. This process is facilitated by the histidine (found in a highly conserved HNF motif) and the penultimate histidine and may also involve the aspartate. This succinimide formation reaction excises the intein from the reactive complex and leaves behind the exteins attached through a non-peptidic linkage. This structure rapidly rearranges into a stable peptide bond in an intein-independent fashion.

Adenosine Deaminases

In some embodiments, the fusion proteins of the invention comprise an adenosine deaminase domain. In some embodiments, the adenosine deaminases provided herein are capable of deaminating adenine. In some embodiments, the adenosine deaminases provided herein are capable of deaminating adenine in a deoxyadenosine residue of DNA. The adenosine deaminase may be derived from any suitable organism (e.g., E. coli). In some embodiments, the adenine deaminase is a naturally-occurring adenosine deaminase that includes one or more mutations corresponding to any of the mutations provided herein (e.g., mutations in ecTadA). One of skill in the art will be able to identify the corresponding residue in any homologous protein, e.g., by sequence alignment and determination of homologous residues. Accordingly, one of skill in the art would be able to generate mutations in any naturally-occurring adenosine deaminase (e.g., having homology to ecTadA) that corresponds to any of the mutations described herein, e.g., any of the mutations identified in ecTadA. In some embodiments, the adenosine deaminase is from a prokaryote. In some embodiments, the adenosine deaminase is from a bacterium. In some embodiments, the adenosine deaminase is from *Escherichia coli, Staphylococcus aureus, Salmonella typhi, Shewanella putrefaciens, Haemophilus influenzae, Caulobacter crescentus,* or *Bacillus subtilis*. In some embodiments, the adenosine deaminase is from *E. coli*.

In one embodiment, a fusion protein of the invention comprises a wild-type TadA linked to TadA7.10, which is linked to Cas9 nickase. In particular embodiments, the fusion proteins comprise a single TadA7.10 domain (e.g., provided as a monomer). In other embodiments, the ABE7.10 editor comprises TadA7.10 and TadA (wt), which are capable of forming heterodimers. The relevant sequences follow:

```
TadA(wt):
                                        (SEQ ID NO: 95)
SEVEFSHEYWMRHALTLAKRAWDEREVPVGAVLVHNNRVIGEGWNRPIGR

HDPTAHAEIMALRQGGLVMQNYRLIDATLYVTLEPCVMCAGAMIHSRIGR

VVFGARDAKTGAAGSLMDVLHHPGMNHRVEITEGILADECAALLSDFFRM

RRQEIKAQKKAQSSTD

TadA7.10:
                                        (SEQ ID NO: 96)
SEVEFSHEYWMRHALTLAKRARDEREVPVGAVLVLNNRVIGEGWNRAIGL

HDPTAHAEIMALRQGGLVMQNYRLIDATLYVTFEPCVMCAGAMIHSRIGR

VVFGVRNAKTGAAGSLMDVLHYPGMNHRVEITEGILADECAALLCYFFRM

PRQVFNAQKKAQSSTD
```

In some embodiments, the TadA (e.g., having double-stranded substrate activity) or TadA7.10 is provided as a homodimer or as a monomer.

In some embodiments, the adenosine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in any of the adenosine deaminases provided herein. It should be appreciated that adenosine deaminases provided herein may include one or more mutations (e.g., any of the mutations provided herein). The disclosure provides any deaminase domains with a certain percent identity plus any of the mutations or combinations thereof described herein. In some embodiments, the adenosine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to a reference sequence, or any of the adenosine deaminases provided herein. In some embodiments, the adenosine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 170 identical contiguous amino acid residues as compared to any one of the amino acid sequences known in the art or described herein.

In some embodiments, the adenosine deaminase comprises a D108X mutation in the TadA reference sequence, or a corresponding mutation in another adenosine deaminase, where X indicates any amino acid other than the corresponding amino acid in the wild-type adenosine deaminase. In some embodiments, the adenosine deaminase comprises a D108G, D108N, D108V, D108A, or D108Y mutation in TadA reference sequence, or a corresponding mutation in another adenosine deaminase. It should be appreciated, however, that additional deaminases may similarly be aligned to identify homologous amino acid residues that can be mutated as provided herein.

In some embodiments, the adenosine deaminase comprises an A106X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an A106V mutation in TadA reference sequence, or a corresponding mutation in another adenosine deaminase.

In some embodiments, the adenosine deaminase comprises a E155X mutation in TadA reference sequence, or a corresponding mutation in another adenosine deaminase, where the presence of X indicates any amino acid other than the corresponding amino acid in the wild-type adenosine deaminase. In some embodiments, the adenosine deaminase comprises a E155D, E155G, or E155V mutation in TadA reference sequence, or a corresponding mutation in another adenosine deaminase.

In some embodiments, the adenosine deaminase comprises a D147X mutation in TadA reference sequence, or a corresponding mutation in another adenosine deaminase, where the presence of X indicates any amino acid other than the corresponding amino acid in the wild-type adenosine deaminase. In some embodiments, the adenosine deaminase comprises a D147Y, mutation in TadA reference sequence, or a corresponding mutation in another adenosine deaminase.

It should be appreciated that any of the mutations provided herein (e.g., based on the ecTadA amino acid sequence of TadA reference sequence) may be introduced into other adenosine deaminases, such as *S. aureus* TadA (saTadA), or other adenosine deaminases (e.g., bacterial adenosine deaminases). It would be apparent to the skilled artisan how to are homologous to the mutated residues in ecTadA. Thus, any of the mutations identified in ecTadA may be made in other adenosine deaminases that have homologous amino acid residues. It should also be appreciated that any of the mutations provided herein may be made individually or in any combination in ecTadA or another adenosine deaminase. For example, an adenosine deaminase may contain a D108N, a A106V, a E155V, and/or a D147Y mutation in TadA reference sequence, or a corresponding mutation in another adenosine deaminase. In some embodiments, an adenosine deaminase comprises the following group of mutations (groups of mutations are separated by a ";") in TadA reference sequence, or corresponding mutations in another adenosine deaminase: D108N and A106V; D108N and E155V; D108N and D147Y; A106V and E155V; A106V and D147Y; E155V and D147Y; D108N, A106V, and E55V; D108N, A106V, and D147Y; D108N, E55V, and D147Y; A106V, E55V, and D 147Y; and D108N, A106V, E55V, and D147Y. It should be appreciated, however, that any combination of corresponding mutations provided herein may be made in an adenosine deaminase (e.g., ecTadA).

In some embodiments, the adenosine deaminase comprises one or more of a H8X, T17X, L18X, W23X, L34X, W45X, R51X, A56X, E59X, E85X, M94X, I95X, V102X, F104X, A106X, R107X, D108X, KI 1OX, M118X, N127X, A138X, F149X, M151X, R153X, Q154X, 1156X, and/or K157X mutation in TadA reference sequence, or one or more corresponding mutations in another adenosine deaminase, where the presence of X indicates any amino acid other than the corresponding amino acid in the wild-type adenosine deaminase. In some embodiments, the adenosine deaminase comprises one or more of H8Y, T17S, L18E, W23L, L34S, W45L, R51H, A56E, or A56S, E59G, E85K, or E85G, M94L, 1951, V102A, F104L, A106V, R107C, or R107H, or R107P, D108G, or D108N, or D108V, or D108A, or D108Y, Kl 101, MI 18K, N127S, A138V, F149Y, M151V, R153C, Q154L, I156D, and/or K157R mutation in TadA reference sequence, or one or more corresponding mutations in another adenosine deaminase.

In some embodiments, the adenosine deaminase comprises one or more of H8X, D108X, and/or N127X mutation in TadA reference sequence, or one or more corresponding mutations in another adenosine deaminase, where X indicates the presence of any amino acid. In some embodiments, the adenosine deaminase comprises one or more of a H8Y, D108N, and/or N127S mutation in TadA reference sequence, or one or more corresponding mutations in another adenosine deaminase.

In some embodiments, the adenosine deaminase comprises one or more of H8X, R26X, M61X, L68X, M70X, A106X, D108X, A109X, N127X, D147X, R152X, Q154X, E155X, K161X, Q163X, and/or T166X mutation in TadA reference sequence, or one or more corresponding mutations in another adenosine deaminase, where X indicates the presence of any amino acid other than the corresponding amino acid in the wild-type adenosine deaminase. In some embodiments, the adenosine deaminase comprises one or more of H8Y, R26W, M61I, L68Q, M70V, A106T, D108N, A109T, N127S, D147Y, R152C, Q154H or Q154R, E155G or E155V or E155D, K161Q, Q163H, and/or T166P mutation in TadA reference sequence, or one or more corresponding mutations in another adenosine deaminase.

In some embodiments, the adenosine deaminase comprises one, two, three, four, five, or six mutations selected from the group consisting of H8X, D108X, N127X, D147X, R152X, and Q154X in TadA reference sequence, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, five, six, seven, or eight mutations selected from the group consisting of H8X, M61X, M70X, D108X, N127X, Q154X, E155X, and Q163X in TadA reference sequence, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five, mutations selected from the group consisting of H8X, D108X, N127X, E155X, and T166X in TadA reference sequence, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, five, or six mutations selected from the group consisting of H8X, A106X, D108X, mutation or mutations in another adenosine deaminase, where X indicates the presence of any amino acid other than the corresponding amino acid in the wild-type adenosine deaminase. In some embodiments, the adenosine deaminase comprises one, two, three, four, five, six, seven, or eight mutations selected from the group consisting of H8X, R126X, L68X, D108X, N127X, D147X, and E155X in TadA reference sequence, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five, mutations selected from the group consisting of H8X, D108X, A109X, N127X, and E155X in TadA reference sequence, or a corresponding mutation or mutations in another adenosine deaminase, where X indicates the presence of any amino acid other than the corresponding amino acid in the wild-type adenosine deaminase.

In some embodiments, the adenosine deaminase comprises one, two, three, four, five, or six mutations selected from the group consisting of H8Y, D108N, N127S, D147Y, R152C, and Q154H in TadA reference sequence, or a corresponding mutation or mutations in another adenosine deaminase. In some embodiments, the adenosine deaminase comprises one, two, three, four, five, six, seven, or eight mutations selected from the group consisting of H8Y, M61I, M70V, D108N, N127S, Q154R, E155G and Q163H in TadA reference sequence, or a corresponding mutation or mutations in another adenosine deaminase. In some embodiments, the adenosine deaminase comprises one, two, three, four, or five, mutations selected from the group consisting of H8Y, D108N, N127S, E155V, and T166P in TadA reference sequence, or a corresponding mutation or mutations in another adenosine deaminase. In some embodiments, the adenosine deaminase comprises one, two, three, four, five, or six mutations selected from the group consisting of H8Y, A106T, D108N, N127S, E155D, and K161Q in TadA reference sequence, or a corresponding mutation or mutations in another adenosine deaminase. In some embodiments, the adenosine deaminase comprises one, two, three, four, five, six, seven, or eight mutations selected from the group consisting of H8Y, R126W, L68Q, D108N, N127S, D147Y, and E155V in TadA reference sequence, or a corresponding mutation or mutations in another adenosine deaminase. In some embodiments, the adenosine deaminase comprises one, two, three, four, or five, mutations selected from the group consisting of H8Y, D108N, A109T, N127S, and E155G in TadA reference sequence, or a corresponding mutation or mutations in another adenosine deaminase.

In some embodiments, the adenosine deaminase comprises one or more of the or one or more corresponding mutations in another adenosine deaminase. In some embodiments, the adenosine deaminase comprises a D108N, D108G, or D108V mutation in TadA reference sequence, or corresponding mutations in another adenosine deaminase. In some embodiments, the adenosine deaminase comprises a A106V and D108N mutation in TadA reference sequence, or corresponding mutations in another adenosine deaminase. In some embodiments, the adenosine deaminase comprises R107C and D108N mutations in TadA reference sequence, or corresponding mutations in another adenosine deaminase. In some embodiments, the adenosine deaminase comprises a H8Y, D108N, N127S, D147Y, and Q154H mutation in TadA reference sequence, or corresponding mutations in another adenosine deaminase. In some embodiments, the adenosine deaminase comprises a H8Y, R24W, D108N, N127S, D147Y, and E155V mutation in TadA reference sequence, or corresponding mutations in another adenosine deaminase. In some embodiments, the adenosine deaminase comprises a D108N, D147Y, and E155V mutation in TadA reference sequence, or corresponding mutations in another adenosine deaminase. In some embodiments, the adenosine deaminase comprises a H8Y, D108N, and S 127S mutation in TadA reference sequence, or corresponding mutations in another adenosine deaminase. In some embodiments, the adenosine deaminase comprises a A106V, D108N, D147Y and E155V mutation in TadA reference sequence, or corresponding mutations in another adenosine deaminase.

In some embodiments, the adenosine deaminase comprises one or more of a, S2X, H8X, I49X, L84X, H123X, N127X, 1156X and/or K160X mutation in TadA reference sequence, or one or more corresponding mutations in another adenosine deaminase, where the presence of X indicates any amino acid other than the corresponding amino acid in the wild-type adenosine deaminase. In some embodiments, the adenosine deaminase comprises one or more of S2A, H8Y, I49F, L84F, H123Y, N127S, 1156F and/or K160S mutation in TadA reference sequence, or one or more corresponding mutations in another adenosine deaminase.

In some embodiments, the adenosine deaminase comprises an L84X mutation adenosine deaminase, where X indicates any amino acid other than the corresponding amino acid in the wild-type adenosine deaminase. In some embodiments, the adenosine deaminase comprises an L84F mutation in TadA reference sequence, or a corresponding mutation in another adenosine deaminase.

In some embodiments, the adenosine deaminase comprises an H123X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an H123Y mutation in TadA reference sequence, or a corresponding mutation in another adenosine deaminase.

In some embodiments, the adenosine deaminase comprises an I157X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an I157F mutation in TadA reference sequence, or a corresponding mutation in another adenosine deaminase.

In some embodiments, the adenosine deaminase comprises one, two, three, four, five, six, or seven mutations selected from the group consisting of L84X, A106X, D108X, H123X, D147X, E155X, and I156X in TadA reference sequence, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, five, or six mutations selected from the group consisting of S2X, I49X, A106X, D108X, D147X, and E155X in TadA reference sequence, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five, mutations selected from the group consisting of H8X, A106X, D108X, N127X, and K160X in TadA reference sequence, or a corresponding mutation or mutations in another adenosine deaminase, where X indicates the presence of any amino acid other than the corresponding amino acid in the wild-type adenosine deaminase.

In some embodiments, the adenosine deaminase comprises one, two, three, four, five, six, or seven mutations selected from the group consisting of L84F, A106V, D108N, H123Y, D147Y, E155V, and I156F in TadA reference sequence, or a corresponding mutation or mutations in another adenosine deaminase. In some embodiments, the adenosine deaminase comprises one, two, three, four, five, or six mutations selected from the group consisting of S2A, I49F, A106V, D108N, D147Y, and E155V in TadA reference sequence.

In some embodiments, the adenosine deaminase comprises one, two, three, four, or five, mutations selected from the group consisting of H8Y, A106T, D108N, N127S, and K160S in TadA reference sequence, or a corresponding mutation or mutations in another adenosine deaminase.

In some embodiments, the adenosine deaminase comprises one or more of a E25X, R26X, R107X, A142X, and/or A143X mutation in TadA reference sequence, or one or more corresponding mutations in another adenosine deaminase, where the presence of X indicates any amino acid other than the corresponding amino acid in the wild-type adenosine deaminase. In some embodiments, the adenosine deaminase comprises one or more of E25M, E25D, E25A, E25R, E25V, E25S, E25Y, R26G, R26N, R26Q, R26C, R26L, R26K, R107P, R07K, R107A, R107N, R107W, R107H, R107S, A142N, A142D, A142G, A143D, A143G, A143E, A143L, A143W, A143M, A143S, A143Q and/or A143R mutation in TadA reference sequence, or one or more corresponding mutations in another adenosine deaminase. In some embodiments, the adenosine deaminase comprises one or more of the mutations described herein corresponding to TadA reference sequence, or one or more corresponding mutations in another adenosine deaminase.

In some embodiments, the adenosine deaminase comprises an E25X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an E25M, E25D, E25A, E25R, E25V, E25S, or E25Y mutation in TadA reference sequence, or a corresponding mutation in another adenosine deaminase.

In some embodiments, the adenosine deaminase comprises an R26X mutation in TadA reference sequence, or a corresponding mutation in another adenosine deaminase, where X indicates any amino acid other than the corresponding amino acid in the wild-type adenosine deaminase. In some embodiments, the adenosine deaminase comprises R26G, R26N, R26Q, R26C, R26L, or R26K mutation in TadA reference sequence, or a corresponding mutation in another adenosine deaminase.

In some embodiments, the adenosine deaminase comprises an R107X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an R107P, R07K, R107A, R107N, R107W, R107H, or R107S mutation in TadA reference sequence, or a corresponding mutation in another adenosine deaminase.

In some embodiments, the adenosine deaminase comprises an A142X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an A142N, A142D, A142G, mutation in TadA reference sequence, or a corresponding mutation in another adenosine deaminase.

In some embodiments, the adenosine deaminase comprises an A143X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an A143D, A143G, A143E, A143L, A143W, A143M, A143S, A143Q and/or A143R mutation in TadA reference sequence, or a corresponding mutation in another adenosine deaminase.

In some embodiments, the adenosine deaminase comprises one or more of a H36X, N37X, P48X, 149X, R51X, M70X, N72X, D77X, E134X, S 146X, Q154X, K157X, and/or K161X mutation in TADA REFERENCE SEQUENCE, or one or more corresponding mutations in another adenosine deaminase, where the presence of X indicates any amino acid other than the corresponding amino acid in the wild-type adenosine deaminase. In some embodiments, the adenosine deaminase comprises one or more of H36L, N37T, N37S, P48T, P48L, I49V, R51H, R51L, M70L, N72S, D77G, E134G, S 146R, S 146C, Q154H, K157N, and/or K161T mutation in TadA reference sequence, or one or more corresponding mutations in another adenosine deaminase.

In some embodiments, the adenosine deaminase comprises an H36X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an H36L mutation in TadA reference sequence, or a corresponding mutation in another adenosine deaminase.

In some embodiments, the adenosine deaminase comprises an N37X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an N37T, or N37S mutation in TadA reference sequence, or a corresponding mutation in another adenosine deaminase.

In some embodiments, the adenosine deaminase comprises an P48X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an P48T, or P48L mutation in TadA reference sequence, or a corresponding mutation in another adenosine deaminase.

In some embodiments, the adenosine deaminase comprises an R51X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an R51H, or R51L mutation in TadA reference sequence, or a corresponding mutation in another adenosine deaminase.

In some embodiments, the adenosine deaminase comprises an S 146X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an S 146R, or S 146C mutation in TadA reference sequence, or a corresponding mutation in another adenosine deaminase.

In some embodiments, the adenosine deaminase comprises an K157X mutation in TadA reference sequence, or a corresponding mutation in another adenosine deaminase, where X indicates any amino acid other than the corresponding amino acid in the wild-type adenosine deaminase. In some embodiments, the adenosine deaminase comprises a K157N mutation in TadA reference sequence, or a corresponding mutation in another adenosine deaminase.

In some embodiments, the adenosine deaminase comprises an P48X mutation in TadA reference sequence, or a corresponding mutation in another adenosine deaminase, where X indicates any amino acid other than the corresponding amino acid in the wild-type adenosine deaminase. In some embodiments, the adenosine deaminase comprises a P48S, P48T, or P48A mutation in TadA reference sequence, or a corresponding mutation in another adenosine deaminase.

In some embodiments, the adenosine deaminase comprises an A142X mutation in TadA reference sequence, or a corresponding mutation in another adenosine deaminase, where X indicates any amino acid other than the corresponding amino acid in the wild-type adenosine deaminase. In some embodiments, the adenosine deaminase comprises a A142N mutation in TadA reference sequence, or a corresponding mutation in another adenosine deaminase.

In some embodiments, the adenosine deaminase comprises an W23X mutation in TadA reference sequence, or a corresponding mutation in another adenosine deaminase, where X indicates any amino acid other than the corresponding amino acid in the wild-type adenosine deaminase. In some embodiments, the adenosine deaminase comprises a W23R, or W23L mutation in TadA reference sequence, or a corresponding mutation in another adenosine deaminase.

In some embodiments, the adenosine deaminase comprises an R152X mutation in TadA reference sequence, or a corresponding mutation in another adenosine deaminase, where X indicates any amino acid other than the corresponding amino acid in the wild-type adenosine deaminase. In some embodiments, the adenosine deaminase comprises a R152P, or R52H mutation in TadA reference sequence, or a corresponding mutation in another adenosine deaminase.

In one embodiment, the adenosine deaminase may comprise the mutations H36L, R51L, L84F, A106V, D108N, H123Y, S 146C, D147Y, E155V, 1156F, and K157N. In some embodiments, the adenosine deaminase comprises the following combination of mutations relative to TadA reference sequence, where each mutation of a combination is separated by a "_" and each combination of mutations is between parentheses: (A106V_D108N), (R107C_D108N), (H8Y_D108N_S 127S_D 147Y_Q154H), (H8Y_R24W_D108N_N127S_D147Y_E155V), (D108N_D147Y_E155V), (H8Y_D108N_S 127S), (H8Y_D108N_N127S_D147Y_Q154H), (A106V_D108N_D147Y_E155V) (D108Q D147Y_E155V) (D108M_D147Y_E155V), (D108L_D147Y_E155V), (D108K_D147Y_E155V), (D108I_D147Y_E155V), (D108F_D147Y_E155V), (A106V_D108N_D147Y), (A106V_D108M_D147Y_E155V), (E59A_A106V_D108N_D147Y_E155V), (E59A cat dead_A106V_D108N_D147Y_E155V), (L84F_A106V_D108N_H123Y_D147Y_E155V_1156Y), (L84F_A106V_D108N_H123Y_D147Y_E155V_ 1156F), (D103A_D014N), (G22P_D 103 A_D 104N), (G22P_D 103 A_D 104N_S 138 A), (D 103 A_D 104N_S 138A), (R26G_L84F_A106V_R107H_ D108N_H123Y_A142N_A143D_D147Y_E155V_ 1156F),
(E25G_R26G_L84F_A106V_R107H_D108N_H123Y_ A142N_A143D_D147Y_E155V_115 6F),
(E25D_R26G_L84F_A106V_R107K_D108N_H123Y_ A142N_A143G_D147Y_E155V 115 6F),
(R26Q_L84F_A106V_D108N_H123Y_A142N_ D147Y_E155V_I156F),
(E25M_R26G_L84F_A106V_R107P_D108N_ H123Y_A142N_A143D_D147Y_E155V 115 6F),
(R26C_L84F_A106V_R107H_D108N_H123Y_ A142N_D147Y_E155V_1156F),
(L84F_A106V_D108N_H123Y_A142N_A143L_ D147Y_E155V_1156F),
(R26G_L84F_A106V_D108N_H123Y_A142N_ D147Y_E155V_1156F),
(E25A_R26G_L84F_A106V_R107N_D108N_H123Y_ A142N_A143E_D147Y_E155V_115 6F)
(R26G_L84F_A106V_R107H_D108N_H123Y_A142N_ A143D_D147Y_E155V_1156F),
(A106V_D108N_A142N_D147Y_E155V),
(R26G_A106V_D108N_A142N_D147Y_E155V),
(E25D_R26G_A106V_R107K_D108N_A142N_ A143G_D147Y_E155V),
(R26G_A106V_D108N_R107H_A142N_A143D_ D147Y_E155V),
(E25D_R26G_A106V_D108N_A142N_D147Y_ E155V),
(A106V_R107K_D108N_A142N_D147Y_E155V),
(A106V_D108N_A142N_A143G_D147Y_E155V),
(A106V_D108N_A142N_A143L_D147Y_E155V),
(H36L_R51L_L84F_A106V_D108N_H123Y_S 146C_D147Y_E155V_1156F_K157N),
(N37T_P48T_M70L_L84F_A106V_D108N_H123Y_ D147Y_149V_E155V_1156F), (N37S_L84F_ A106V_D108N_H123Y_D147Y_E155V_1156F_ K161T),
(H36L_L84F_A106V_D108N_H123Y_D147Y_Q154H_ E155V_I156F),
(N72S_L84F_A106V_D108N_H123Y_S 146R_D147Y_E155V_I156F), (H36L_P48L_ L84F_A106V_D108N_H123Y_E134G_D147Y_ E155V_1156F), 57N),
(H36L_L84F_A106V_D108N_H123Y_S 146C_D147Y_E155V_1156F),
(L84F_A106V_D108N_H123Y_S 146R_D147Y_E155V_1156F_K161T),
(N37S_R51H_D77G_L84F_A106V_D108N_H123Y_ D147Y_E155V_I156F), (R51L_L84F_A106V_ D108N_H123Y_D147Y_E155V_1156F_K157N),
(D24G_Q71R_L84F_H96L_A106V_D108N_H123Y_ D147Y_E155V_1156F_K160E),
(H36L_G67V_L84F_A106V_D108N_H123Y_S 146T_D147Y_E155V_1156F),
(Q71L_L84F_A106V_D108N_H123Y_L137M_A143E_ D147Y_E155V_1156F), (E25G_L84F_A106V_ D108N_H123Y_D147Y_E155V_1156F_Q159L),
(L84F_A91T_F104I_A106V_D108N_H123Y_ D147Y_E155V_1156F),
(N72D_L84F_A106V_D108N_

H123Y_G125A_D147Y_E155V_I156F),
(P48S_L84F_S97C_A106V_D108N_H123Y_D147Y_E155V_I156F),
(W23G_L84F_A106V_D108N_H123Y_D147Y_E155V_I156F),
(D24G_P48L_Q71R_L84F_A106V_D108N_H123Y_D147Y_E155V_I156F_Q159L),
(L84F_A106V_D108N_H123Y_A142N_D147Y_E155V_I156F),
(H36L_R51L_L84F_A106V_D108N_H123Y_A142N_S 146C_D147Y_E155V_1156F K157N),
(N37S_L84F_A106V_D108N_H123Y_A142N_D147Y_E155V_I156F_K161T),
(L84F_A106V_D108N_D147Y_E155V_I156F),
(R51L_L84F_A106V_D108N_H123Y_S 146C_D147Y_E155V_1156F_K157N_K161T),
(L84F_A106V_D108N_H123Y_S 146C_D147Y_E155V_1156F_K161T),
(L84F_A106V_D108N_H123Y_S 146C_D147Y_E155V_1156F_K157N_K160E_K161T),
(L84F_A106V_D108N_H123Y_S 146C_D147Y_E155V_1156F_K157N_K160E),
(R74Q L84F_A106V_D108N_H123Y_D147Y_E155V_I156F), (R74A_L84F_A106V_D108N_H123Y_D147Y_E155V_I156F),
(L84F_A106V_D108N_H123Y_D147Y_E155V_I156F),
(R74Q_L84F_A106V_D108N_H123Y_D147Y_E155V_I156F), (L84F_R98Q_A106V_D108N_H123Y_D147Y_E155V_I156F), (L84F_A106V_D108N_H123Y_R129Q_D147Y_E155V_1156F),
(P48S_L84F_A106V_D108N_H123Y_A142N_D147Y_E155V_1156F), (P48S_A142N),
(P48T_I49V_L84F_A106V_D108N_H123Y_A142N_D147Y_E155V_1156F_L157N),
(P48T_I49V_A142N),
(H36L_P48S_R51L L84F_A106V_D108N_H123Y_S 146C_D147Y_E155V 1156F K157N),
(H36L_P48S_R51L_L84F_A106V_D108N_H123Y_S 146C_A142N_D147Y_E155V_1156F
(H36L_P48T_I49V_R51L_L84F_A106V_D108N_H123Y_S 146C_D147Y_E155V 1156F K157N),
(H36L_P48T_I49V_R51L_L84F_A106V_D108N_H123Y_A142N_S 146C_D147Y_E155V_1156F_K157N),
(H36L_P48A_R51L_L84F_A106V_D108N_H123Y_S 146C_D147Y_E155V_1156F_K157N),
(H36L_P48A_R51L_L84F_A106V_D108N_H123Y_A142N_S 146C_D147Y_E155V_1156F_K157N),
(H36L_P48A_R51L L84F_A106V_D108N_H123Y_S 146C_A142N_D147Y_E155V_1156F_K157N),
(W23L_H36L_P48A_R51L_L84F_A106V_D108N_H123Y_S 146C_D147Y_E155V_1156F K157N),
(W23R_H36L_P48A_R51L_L84F_A106V_D108N_H123Y_S 146C_D147Y_E155V_1156F K157N),
(W23L_H36L_P48A_R51L_L84F_A106V_D108N_H123Y_S 146R_D147Y_E155V_1156F K161T),
(H36L_P48A_R51L_L84F_A106V_D108N_H123Y_S 146C_D147Y_R152H_E155V_1156F_K157N),
(H36L_P48A_R51L_L84F_A106V_D108N_H123Y_S 146C_D147Y_R152P_E155V_1156F K157N),
(W23L_H36L_P48A_R51L_L84F_A106V_D108N_H123Y_S 146C_D147Y_R152P E155V 1156F_K157N),
(W23L_H36L_P48A_R51L_L84F_A106V_D108N_H123Y_A142A_S 146C_D147Y_E155V_1156F_K157N),
(W23L_H36L_P48A_R51L_L84F_A106V_D108N_H123Y_A142A_S 146C_D147Y_R152P E155V_1156F_K157N),
(W23L_H36L_P48A_R51L_L84F_A106V_D108N_H123Y_S 146R_D147Y_E155V_1156F K161T),
(W23R_H36L_P48A_R51L_L84F_A106V_D108N_H123Y_S 146C_D147Y_R152P_E155V_1156F_K157N),
(H36L_P48A_R51L_L84F_A106V_D108N_H123Y_A142N_S 146C_D147Y_R152P_E155 V I156F_K157N).

Cytidine Deaminase

In one embodiment, a fusion protein of the invention comprises a cytidine deaminase. In some embodiments, the cytidine deaminases provided herein are capable of deaminating cytosine or 5-methylcytosine to uracil or thymine. In some embodiments, the cytosine deaminases provided herein are capable of deaminating cytosine in DNA. The cytidine deaminase may be derived from any suitable organism. In some embodiments, the cytidine deaminase is a naturally-occurring cytidine deaminase that includes one or more mutations corresponding to any of the mutations provided herein. One of skill in the art will be able to identify the corresponding residue in any homologous protein, e.g., by sequence alignment and determination of homologous residues. Accordingly, one of skill in the art would be able to generate mutations in any naturally-occurring cytidine deaminase that corresponds to any of the mutations described herein. In some embodiments, the cytidine deaminase is from a prokaryote. In some embodiments, the cytidine deaminase is from a bacterium. In some embodiments, the cytidine deaminase is from a mammal (e.g., human).

In some embodiments, the cytidine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the cytidine deaminase amino acid sequences set forth herein. It should be appreciated that cytidine deaminases provided herein may include one or more mutations (e.g., any of the mutations provided herein). The disclosure provides any deaminase domains with a certain percent identity plus any of the mutations or combinations thereof described herein. In some embodiments, the cytidine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to a reference sequence, or any of the cytidine deaminases provided herein. In some embodiments, the cytidine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 170 identical contiguous amino acid residues as compared to any one of the amino acid sequences known in the art or described herein.

A fusion protein of the invention comprises a nucleic acid editing domain. In some embodiments, the nucleic acid editing domain can catalyze a C to U base change. In some embodiments, the nucleic acid editing domain is a deaminase domain. In some embodiments, the deaminase is a cytidine deaminase or an adenosine deaminase. In some embodiments, the deaminase is an apolipoprotein B mRNA-editing complex (APOBEC) family deaminase. In some embodiments, the deaminase is an APOBEC1 deaminase. In some embodiments, the deaminase is an APOBEC2 deaminase. In some embodiments, the deaminase is an APOBEC3 deaminase. In some embodiments, the deaminase is an APOBEC3A deaminase. In some embodiments, the deaminase is an APOBEC3B deaminase. In some embodiments, the deaminase is an APOBEC3C deaminase. In some embodiments, the deaminase is an APOBEC3D deaminase. In some embodiments, the deaminase is an APOBEC3E deaminase. In some embodiments, the deaminase is an APOBEC3F deaminase. In some embodiments, the deaminase is an APOBEC3G deaminase. In some embodiments, the deaminase is an APOBEC3H deaminase. In some embodiments, the deaminase is an APOBEC4 deaminase. In some embodiments, the deaminase is an activation-induced deaminase (AID). In some embodiments, the deaminase is a vertebrate deaminase. In some embodiments, the deaminase is an invertebrate deaminase. In some embodiments, the deaminase is a human, chimpanzee, gorilla, monkey, cow, dog, rat, or mouse deaminase. In some embodiments, the deaminase is a human deaminase. In some embodiments, the deaminase is a rat deaminase, e.g., rAPOBEC1. In some embodiments, the deaminase is a *Petromyzon marinus* cytidine deaminase 1 (pmCDA1). In some embodiments, the deaminase is a human APOBEC3G. In some embodiments, the deaminase is a fragment of the human APOBEC3G. In some embodiments, the deaminase is a human APOBEC3G variant comprising a D316R D317R mutation. In some embodiments, the deaminase is a fragment of the human APOBEC3G and comprising mutations corresponding to the D316R D317R mutations. In some embodiments, the nucleic acid editing domain is at least 80%, at least 85%, at least 90%, at least 92%, at least 95%, at least 96%, at least 97%, at least 98%, at least 99%), or at least 99.5% identical to the deaminase domain of any deaminase described herein.

In certain embodiments, the fusion proteins provided herein comprise one or more features that improve the base editing activity of the fusion proteins. For example, any of the fusion proteins provided herein may comprise a Cas9 domain that has reduced nuclease activity. In some embodiments, any of the fusion proteins provided herein may have a Cas9 domain that does not have nuclease activity (dCas9), or a Cas9 domain that cuts one strand of a duplexed DNA molecule, referred to as a Cas9 nickase (nCas9).

Other Nucleobase Editors

The invention provides for a nucleobase editor fusion protein where virtually any nucleobase editor known in the art can be substituted for a cytidine deaminase or adenosine deaminase domain in a fusion protein of the invention.

Cas9 domains of Nucleobase Editors

In some aspects, a nucleic acid programmable DNA binding protein (napDNAbp) is a Cas9 domain. Non-limiting, exemplary Cas9 domains are provided herein. The Cas9 domain may be a nuclease active Cas9 domain, a nuclease inactive Cas9 domain, or a Cas9 nickase. In some embodiments, the Cas9 domain is a nuclease active domain. For example, the Cas9 domain may be a Cas9 domain that cuts both strands of a duplexed nucleic acid (e.g., both strands of a duplexed DNA molecule). In some embodiments, the Cas9 domain comprises any one of the amino acid sequences as set forth herein. In some embodiments the Cas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth herein. In some embodiments, the Cas9 domain comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more or more mutations compared to any one of the amino acid sequences set forth herein. In some embodiments, the Cas9 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any one of the amino acid sequences set forth herein.

In some embodiments, the Cas9 domain is a nuclease-inactive Cas9 domain (dCas9). For example, the dCas9 domain may bind to a duplexed nucleic acid molecule (e.g., via a gRNA molecule) without cleaving either strand of the duplexed nucleic acid molecule. In some embodiments, the nuclease-inactive dCas9 domain comprises a D10X mutation and a H840X mutation of the amino acid sequence set forth herein, or a corresponding mutation in any of the amino acid sequences provided herein, wherein X is any amino acid change. In some embodiments, the nuclease-inactive dCas9 domain comprises a D10A mutation and a H840A mutation of the amino acid sequence set forth herein, or a corresponding mutation in any of the amino acid sequences provided herein. As one example, a nuclease-inactive Cas9 domain comprises the amino acid sequence set forth in Cloning vector pPlatTET-gRNA2 (Accession No. BAV54124).

(SEQ ID NO: 17)
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDAIVPQSFLKDD

SIDNKVLTRSDKNRGKSDNVPSEEVVKKMKNYWRQLLNAKLITQRKFDNL

-continued
TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

DNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQ

SITGLYETRIDLSQLGGD
(see, e.g., Qi et al., "Repurposing CRISPR as an
RNA-guided platform for sequence-specific control
of gene expression." Cell. 2013; 152(5): 1173-83,
the entire contents of which are incorporated
herein by reference).

Additional suitable nuclease-inactive dCas9 domains will be apparent to those of skill in the art based on this disclosure and knowledge in the field, and are within the scope of this disclosure. Such additional exemplary suitable nuclease-inactive Cas9 domains include, but are not limited to, D10A/H840A, D10A/D839A/H840A, and D10A/D839A/H840A/N863A mutant domains (See, e.g., Prashant et al., CAS9 transcriptional activators for target specificity screening and paired nickases for cooperative genome engineering. *Nature Biotechnology*. 2013; 31 (9): 833-838, the entire contents of which are incorporated herein by reference). In some embodiments the dCas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the dCas9 domains provided herein. In some embodiments, the Cas9 domain comprises an amino acid sequences that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more or more mutations compared to any one of the amino acid sequences set forth herein. In some embodiments, the Cas9 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any one of the amino acid sequences set forth herein.

In some embodiments, the Cas9 domain is a Cas9 nickase. The Cas9 nickase may be a Cas9 protein that is capable of cleaving only one strand of a duplexed nucleic acid molecule (e.g., a duplexed DNA molecule). In some embodiments the Cas9 nickase cleaves the target strand of a duplexed nucleic acid molecule, meaning that the Cas9 nickase cleaves the strand that is base paired to (complementary to) a gRNA (e.g., an sgRNA) that is bound to the Cas9. In some embodiments, a Cas9 nickase comprises a D10A mutation and has a histidine at position 840. In some embodiments the Cas9 nickase cleaves the non-target, non-base-edited strand of a duplexed nucleic acid molecule, meaning that the Cas9 nickase cleaves the strand that is not base paired to a gRNA (e.g., an sgRNA) that is bound to the Cas9. In some embodiments, a Cas9 nickase comprises an H840A mutation and has an aspartic acid residue at position 10, or a corresponding mutation. In some embodiments the Cas9 nickase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the Cas9 nickases provided herein. Additional suitable Cas9 nickases will be apparent to those of skill in the art based on this disclosure and knowledge in the field, and are within the scope of this disclosure.

Cas9 Domains with Reduced PAM Exclusivity

In one particular embodiment, the invention features a nucleobase editor comprising a Cas9 domain split into two fragments, each having terminal inteins, i.e., the N-terminal fragment fused to one member of the intein system at its C-terminal, and the C-terminal fragment having a member of the intein system at its N-terminal:

Typically, Cas9 proteins, such as Cas9 from *S. pyogenes* (spCas9), require a canonical NGG PAM sequence to bind a particular nucleic acid region, where the "N" in "NGG" is adenosine (A), thymidine (T), or cytosine (C), and the G is guanosine. This may limit the ability to edit desired bases within a genome. In some embodiments, the base editing fusion proteins provided herein may need to be placed at a precise location, for example a region comprising a target base that is upstream of the PAM. See e.g., Komor, A. C., et al., "Programmable editing of a target base in genomic DNA without double-stranded DNA cleavage" Nature 533, 420-424 (2016), the entire contents of which are hereby incorporated by reference. Accordingly, in some embodiments, any of the fusion proteins provided herein may contain a Cas9 domain that is capable of binding a nucleotide sequence that does not contain a canonical (e.g., NGG) PAM sequence. Cas9 domains that bind to non-canonical PAM sequences have been described in the art and would be apparent to the skilled artisan. For example, Cas9 domains that bind non-canonical PAM sequences have been described in Kleinstiver, B. P., et al., "Engineered CRISPR-Cas9 nucleases with altered PAM specificities" Nature 523, 481-485 (2015); and Kleinstiver, B. P., et al., "Broadening the targeting range of *Staphylococcus aureus* CRISPR-Cas9 by modifying PAM recognition" Nature Biotechnology 33, 1293-1298 (2015); the entire contents of each are hereby incorporated by reference. Several PAM variants are described at Table 1 below:

TABLE 1

| Cas9 proteins and corresponding PAM sequences | |
|---|---|
| Variant | PAM |
| spCas9 | NGG |
| spCas9-VRQR | NGA |
| spCas9-VRER | NGCG |
| SpCas9-MQKFRAER | NGC |
| xCas9 (sp) | NGN |
| saCas9 | NNGRRT |
| saCas9-KKH | NNNRRT |
| spCas9-MQKSER | NGCG |
| spCas9-MQKSER | NGCN |

TABLE 1-continued

Cas9 proteins and corresponding PAM sequences

| Variant | PAM |
|---|---|
| spCas9-LRKIQK | NGTN |
| spCas9-LRVSQK | NGTN |
| spCas9-LRVSQL | NGTN |
| Spy MacCas9 | NAA |
| Cpf1 | 5' (TTTV) |

In some embodiments, the PAM is NGC. In some embodiments, the NGC PAM is recognized by a Cas9 variant. In some embodiments, the NGC PAM variant includes one or more amino acid substitutions selected from D1135M, S1136Q, G1218K, E1219F, A1322R, D1332A, R1335E, and T1337R (collectively termed "MQKFRAER").

In some embodiments, the Cas9 domain is a Cas9 domain from *Staphylococcus aureus* (SaCas9). In some embodiments, the SaCas9 domain is a nuclease active SaCas9, a nuclease inactive SaCas9 (SaCas9d), or a SaCas9 nickase (SaCas9n). In some embodiments, the SaCas9 comprises a N579A mutation, or a corresponding mutation in any of the amino acid sequences provided herein.

In some embodiments, the SaCas9 domain, the SaCas9d domain, or the SaCas9n domain can bind to a nucleic acid sequence having a non-canonical PAM. In some embodiments, the SaCas9 domain, the SaCas9d domain, or the SaCas9n domain can bind to a nucleic acid sequence having a NNGRRT PAM sequence. In some embodiments, the SaCas9 domain comprises one or more of a E781X, a N967X, and a R1014X mutation, or a corresponding mutation in any of the amino acid sequences provided herein, wherein X is any amino acid. In some embodiments, the SaCas9 domain comprises one or more of a E781K, a N967K, and a R1014H mutation, or one or more corresponding mutation in any of the amino acid sequences provided herein. In some embodiments, the SaCas9 domain comprises a E781K, a N967K, or a R1014H mutation, or corresponding mutations in any of the amino acid sequences provided herein.

Exemplary SaCas9 sequence
(SEQ ID NO: 97)
KRNYILGLDIGITSVGYGIIDYETRDVIDAGVRLFKEANVENNEGRRSKR

GARRLKRRRRHRIQRVKKLLFDYNLLTDHSELSGINPYEARVKGLSQKLS

EEEFSAALLHLAKRRGVHNVNEVEEDTGNELSTKEQISRNSKALEEKYVA

ELQLERLKKDGEVRGSINRFKTSDYVKEAKQLLKVQKAYHQLDQSFIDTY

IDLLETRRTYYEGPGEGSPFGWKDIKEWYEMLMGHCTYFPEELRSVKYAY

NADLYNALNDLNNLVITRDENEKLEYYEKFQIIENVFKQKKKPTLKQIAK

EILVNEEDIKGYRVTSTGKPEFTNLKVYHDIKDITARKEIIENAELLDQI

AKILTIYQSSEDIQEELTNLNSELTQEEIEQISNLKGYTGTHNLSLKAIN

LILDELWHTNDNQIAIFNRLKLVPKKVDLSQQKEIPTTLVDDFILSPVVK

RSFIQSIKVINAIIKKYGLPNDIIIELAREKNSKDAQKMINEMQKRNRQT

NERIEEIIRTTGKENAKYLIEKIKLHDMQEGKCLYSLEAIPLEDLLNNPF

NYEVDHIIPRSVSFDNSFNNKVLVKQEENSKKGNRTPFQYLSSSDSKISY

ETFKKHILNLAKGKGRISKTKKEYLLEERDINRFSVQKDFINRNLVDTRY

ATRGLMNLLRSYFRVNNLDVKVKSINGGFTSFLRRKWKFKKERNKGYKHH

AEDALIIANADFIFKEWKKLDKAKKVMENQMFEEKQAESMPEIETEQEYK

EIFITPHQIKHIKDFKDYKYSHRVDKKPNRELINDTLYSTRKDDKGNTLI

VNNLNGLYDKDNDKLKKLINKSPEKLLMYHHDPQTYQKLKLIMEQYGDEK

NPLYKYYEETGNYLTKYSKKDNGPVIKKIKYYGNKLNAHLDITDDYPNSR

NKVVKLSLKPYRFDVYLDNGVYKFVTVKNLDVIKKENYYEVNSKCYEEAK

KLKKISNQAEFIASFYNNDLIKINGELYRVIGVNNDLLNRIEVNMIDITY

REYLENMNDKRPPRIIKTIASKTQSIKKYSTDILGNLYEVKSKKHPQIIK

KG

Residue N579 above, which is underlined and in bold, may be mutated (e.g., to a A579) to yield a SaCas9 nickase.

Exemplary SaCas9n sequence
(SEQ ID NO: 98)
KRNYILGLDIGITSVGYGIIDYETRDVIDAGVRLFKEANVENNEGRRSKR

GARRLKRRRRHRIQRVKKLLFDYNLLTDHSELSGINPYEARVKGLSQKLS

EEEFSAALLHLAKRRGVHNVNEVEEDTGNELSTKEQISRNSKALEEKYVA

ELQLERLKKDGEVRGSINRFKTSDYVKEAKQLLKVQKAYHQLDQSFIDTY

IDLLETRRTYYEGPGEGSPFGWKDIKEWYEMLMGHCTYFPEELRSVKYAY

NADLYNALNDLNNLVITRDENEKLEYYEKFQIIENVFKQKKKPTLKQIAK

EILVNEEDIKGYRVTSTGKPEFTNLKVYHDIKDITARKEIIENAELLDQI

AKILTIYQSSEDIQEELTNLNSELTQEEIEQISNLKGYTGTHNLSLKAIN

LILDELWHTNDNQIAIFNRLKLVPKKVDLSQQKEIPTTLVDDFILSPVVK

RSFIQSIKVINAIIKKYGLPNDIIIELAREKNSKDAQKMINEMQKRNRQT

NERIEEIIRTTGKENAKYLIEKIKLHDMQEGKCLYSLEAIPLEDLLNNPF

NYEVDHIIPRSVSFDNSFNNKVLVKQEEASKKGNRTPFQYLSSSDSKISY

ETFKKHILNLAKGKGRISKTKKEYLLEERDINRFSVQKDFINRNLVDTRY

ATRGLMNLLRSYFRVNNLDVKVKSINGGFTSFLRRKWKFKKERNKGYKHH

AEDALIIANADFIFKEWKKLDKAKKVMENQMFEEKQAESMPEIETEQEYK

EIFITPHQIKHIKDFKDYKYSHRVDKKPNRELINDTLYSTRKDDKGNTLI

VNNLNGLYDKDNDKLKKLINKSPEKLLMYHHDPQTYQKLKLIMEQYGDEK

NPLYKYYEETGNYLTKYSKKDNGPVIKKIKYYGNKLNAHLDITDDYPNSR

NKVVKLSLKPYRFDVYLDNGVYKFVTVKNLDVIKKENYYEVNSKCYEEAK

KLKKISNQAEFIASFYNNDLIKINGELYRVIGVNNDLLNRIEVNMIDITY

REYLENMNDKRPPRIIKTIASKTQSIKKYSTDILGNLYEVKSKKHPQIIK

KG

Residue A579 above, which can be mutated from N579 to yield a SaCas9 nickase, is underlined and in bold.

Exemplary SaKKH Cas9
(SEQ ID NO: 99)
KRNYILGLDIGITSVGYGIIDYETRDVIDAGVRLFKEANVENNEGRRSKR

GARRLKRRRRHRIQRVKKLLFDYNLLTDHSELSGINPYEARVKGLSQKLS

EEEFSAALLHLAKRRGVHNVNEVEEDTGNELSTKEQISRNSKALEEKYVA

-continued

```
ELQLERLKKDGEVRGSINRFKTSDYVKEAKQLLKVQKAYHQLDQSFIDTY

IDLLETRRTYYEGPGEGSPFGWKDIKEWYEMLMGHCTYFPEELRSVKYAY

NADLYNALNDLNNLVITRDENEKLEYYEKFQIIENVFKQKKKPTLKQIAK

EILVNEEDIKGYRVTSTGKPEFTNLKVYHDIKDITARKEIIENAELLDQI

AKILTIYQSSEDIQEELTNLNSELTQEEIEQISNLKGYTGTHNLSLKAIN

LILDELWHTNDNQIAIFNRLKLVPKKVDLSQQKEIPTTLVDDFILSPVVK

RSFIQSIKVINAIIKKYGLPNDIIIELAREKNSKDAQKMINEMQKRNRQT

NERIEEIIRTTGKENAKYLIEKIKLHDMQEGKCLYSLEAIPLEDLLNNPF

NYEVDHIIPRSVSFDNSFNNKVLVKQEEASKKGNRTPFQYLSSSDSKISY

ETFKKHILNLAKGKGRISKTKKEYLLEERDINRFSVQKDFINRNLVDTRY

ATRGLMNLLRSYFRVNNLDVKVKSINGGFTSFLRRKWKFKKERNKGYKHH

AEDALIIANADFIFKEWKKLDKAKKVMENQMFEEKQAESMPEIETEQEYK

EIFITPHQIKHIKDFKDYKYSHRVDKKPNRKLINDTLYSTRKDDKGNTLI

VNNLNGLYDKDNDKLKKLINKSPEKLLMYHHDPQTYQKLKLIMEQYGDEK

NPLYKYYEETGNYLTKYSKKDNGPVIKKIKYYGNKLNAHLDITDDYPNSR

NKVVKLSLKPYRFDVYLDNGVYKFVTVKNLDVIKKENYYEVNSKCYEEAK

KLKKISNQAEFIASFY*K*NDLIKINGELYRVIGVNNDLLNRIEVNMIDITY

REYLENMNDKRPP*H*IIKTIASKTQSIKKYSTDILGNLYEVKSKKHPQIIK

KG.
```

Residue A579 above, which can be mutated from N579 to yield a SaCas9 nickase, is underlined and in bold. Residues K781, K967, and H1014 above, which can be mutated from E781, N967, and R1014 to yield a SaKKH Cas9 are underlined and in italics.

In some embodiments, the Cas9 domain is a Cas9 domain from *Streptococcus pyogenes* (SpCas9). In some embodiments, the SpCas9 domain is a nuclease active SpCas9, a nuclease inactive SpCas9 (SpCas9d), or a SpCas9 nickase (SpCas9n). In some embodiments, the SpCas9 comprises a D9X mutation, or a corresponding mutation in any of the amino acid sequences provided herein, wherein X is any amino acid except for D. In some embodiments, the SpCas9 comprises a D9A mutation, or a corresponding mutation in any of the amino acid sequences provided herein. In some embodiments, the SpCas9 domain, the SpCas9d domain, or the SpCas9n domain can bind to a nucleic acid sequence having a non-canonical PAM. In some embodiments, the SpCas9 domain, the SpCas9d domain, or the SpCas9n domain can bind to a nucleic acid sequence having an NGG, a NGA, or a NGCG PAM sequence. In some embodiments, the SpCas9 domain comprises one or more of a D1134X, a R1334X, and a T1336X mutation, or a corresponding mutation in any of the amino acid sequences provided herein, wherein X is any amino acid. In some embodiments, the SpCas9 domain comprises one or more of a D1134E, R1334Q, and T1336R mutation, or a corresponding mutation in any of the amino acid sequences provided herein. In some embodiments, the SpCas9 domain comprises a D1134E, a R1334Q, and a T1336R mutation, or corresponding mutations in any of the amino acid sequences provided herein. In some embodiments, the SpCas9 domain comprises one or more of a D1134X, a R1334X, and a T1336X mutation, or a corresponding mutation in any of the amino acid sequences provided herein, wherein X is any amino acid. In some embodiments, the SpCas9 domain comprises one or more of a D1134V, a R1334Q, and a T1336R mutation, or a corresponding mutation in any of the amino acid sequences provided herein. In some embodiments, the SpCas9 domain comprises a D1134V, a R1334Q, and a T1336R mutation, or corresponding mutations in any of the amino acid sequences provided herein. In some embodiments, the SpCas9 domain comprises one or more of a D1134X, a G1217X, a R1334X, and a T1336X mutation, or a corresponding mutation in any of the amino acid sequences provided herein, wherein X is any amino acid. In some embodiments, the SpCas9 domain comprises one or more of a D1134V, a G1217R, a R1334Q, and a T1336R mutation, or a corresponding mutation in any of the amino acid sequences provided herein. In some embodiments, the SpCas9 domain comprises a D1134V, a G1217R, a R1334Q, and a T1336R mutation, or corresponding mutations in any of the amino acid sequences provided herein.

In some embodiments, the Cas9 domains of any of the fusion proteins provided herein comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to a Cas9 polypeptide described herein. In some embodiments, the Cas9 domains of any of the fusion proteins provided herein comprises the amino acid sequence of any Cas9 polypeptide described herein. In some embodiments, the Cas9 domains of any of the fusion proteins provided herein consists of the amino acid sequence of any Cas9 polypeptide described herein.

Exemplary SpCas9

(SEQ ID NO: 20)
```
DKKYSIGLDIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY
```

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGD

Exemplary SpCas9n
(SEQ ID NO: 19)
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGD

Exemplary SpEQR Cas9
(SEQ ID NO: 100)
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFESPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKQYRSTKEVLDATLIHQS

ITGLYETRIDLSQLGGD

Residues E1134, Q1334, and R1336 above, which can be mutated from D1134, R1334, and T1336 to yield a SpEQR Cas9, are underlined and in bold.

Exemplary SpVQR Cas9
(SEQ ID NO: 101)
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGF<u>V</u>SPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRK<u>QY</u>R<u></u>STKEVLDATLIHQS

ITGLYETRIDLSQLGGD
Residues V1134, Q1334, and R1336 above, which can
be mutated from D1134, R1334, and T1336 to yield a
SpVQR Cas9, are underlined and in bold.

Exemplary SpVRER Cas9

(SEQ ID NO: 102)

DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVSDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGF<u>V</u>SPTVAYSVLVVAKVEK

GKSKKLKSVKELLGITIMERSSFEKNPIDFLEAKGYKEVKKDLIIKLPKY

SLFELENGRKRMLASA<u>R</u>ELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRK<u>EYR</u>STKEVLDATLIHQS

ITGLYETRIDLSQLGGD.

Residues V1134, R1217, Q1334, and R1336 above, which can be mutated from D1134, G1217, R1334, and T1336 to yield a SpVRER Cas9, are underlined and in bold.

In particular embodiments, a fusion protein of the invention comprises a dCas9 domain that binds a canonical PAM sequence and an nCas9 domain that binds a non-canonical PAM sequence (e.g., a non-canonical PAM identified in Table 1). In another embodiment, a fusion protein of the invention comprises an nCas9 domain that binds a canonical PAM sequence and an dCas9 domain that binds a non-canonical PAM sequence (e.g., a non-canonical PAM identified in Table 1).

High Fidelity Cas9 Domains

Some aspects of the disclosure provide high fidelity Cas9 domains. In some embodiments, high fidelity Cas9 domains are engineered Cas9 domains comprising one or more mutations that decrease electrostatic interactions between the Cas9 domain and a sugar-phosphate backbone of a DNA, as compared to a corresponding wild-type Cas9 domain. Without wishing to be bound by any particular theory, high fidelity Cas9 domains that have decreased electrostatic interactions with a sugar-phosphate backbone of DNA may have less off-target effects. In some embodiments, a Cas9 domain (e.g., a wild type Cas9 domain) comprises one or more mutations that decreases the association between the Cas9 domain and a sugar-phosphate backbone of a DNA. In some embodiments, a Cas9 domain comprises one or more mutations that decreases the association between the Cas9 domain and a sugar-phosphate backbone of a DNA by at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, or at least 70%.

In some embodiments, any of the Cas9 fusion proteins provided herein comprise one or more of a N497X, a R661X, a Q695X, and/or a Q926X mutation, or a corresponding mutation in any of the amino acid sequences provided herein, wherein X is any amino acid. In some embodiments, any of the Cas9 fusion proteins provided herein comprise one or more of a N497A, a R661A, a Q695A, and/or a Q926A mutation, or a corresponding mutation in any of the amino acid sequences provided herein. In some embodiments, the Cas9 domain comprises a D10A mutation, or a corresponding mutation in any of the amino acid sequences provided herein. Cas9 domains with high fidelity are known in the art and would be apparent to the skilled artisan. For example, Cas9 domains with high fidelity have been described in Kleinstiver, B. P., et al. "High-fidelity CRISPR-Cas9 nucleases with no detectable genome-wide off-target effects." Nature 529, 490-495 (2016); and Slaymaker, I. M., et al. "Rationally engineered Cas9 nucleases with improved specificity." Science 351, 84-88 (2015); the entire contents of each are incorporated herein by reference.

High Fidelity Cas9 domain mutations relative to Cas9 are shown in bold and underlines (SEQ ID NO: 103)

DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTAFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGALSRKLINGIRDKQSGKTILDFLKSDGFANRNFMALIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRAITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGD

The Cas9 nuclease has two functional endonuclease domains: RuvC and HNH. Cas9 undergoes a conformational change upon target binding that positions the nuclease domains to cleave opposite strands of the target DNA. The end result of Cas9-mediated DNA cleavage is a double-strand break (DSB) within the target DNA (~3-4 nucleotides upstream of the PAM sequence). The resulting DSB is then repaired by one of two general repair pathways: (1) the efficient but error-prone non-homologous end joining (NHEJ) pathway; or (2) the less efficient but high-fidelity homology directed repair (HDR) pathway.

The "efficiency" of non-homologous end joining (NHEJ) and/or homology directed repair (HDR) can be calculated by any convenient method. For example, in some cases, efficiency can be expressed in terms of percentage of successful HDR. For example, a surveyor nuclease assay can be used to generate cleavage products and the ratio of products to substrate can be used to calculate the percentage. For example, a surveyor nuclease enzyme can be used that directly cleaves DNA containing a newly integrated restriction sequence as the result of successful HDR. More cleaved substrate indicates a greater percent HDR (a greater efficiency of HDR). As an illustrative example, a fraction (percentage) of HDR can be calculated using the following equation [(cleavage products)/(substrate plus cleavage products)] (e.g., (b+c)/(a+b+c), where "a" is the band intensity of DNA substrate and "b" and "c" are the cleavage products).

In some cases, efficiency can be expressed in terms of percentage of successful NHEJ. For example, a T7 endonuclease I assay can be used to generate cleavage products and the ratio of products to substrate can be used to calculate the percentage NHEJ. T7 endonuclease I cleaves mismatched heteroduplex DNA which arises from hybridization of wild-type and mutant DNA strands (NHEJ generates small random insertions or deletions (indels) at the site of the original break). More cleavage indicates a greater percent NHEJ (a greater efficiency of NHEJ). As an illustrative example, a fraction (percentage) of NHEJ can be calculated using the following equation: $(1-(1-(b+c)/(a+b+c))^{1/2}) \times 100$, where "a" is the band intensity of DNA substrate and "b" and "c" are the cleavage products (Ran et. al., 2013 September 12; 154 (6): 1380-9; and Ran et al., Nat Protoc. 2013 November; 8 (11): 2281-2308).

The NHEJ repair pathway is the most active repair mechanism, and it frequently causes small nucleotide insertions or deletions (indels) at the DSB site. The randomness of NHEJ-mediated DSB repair has important practical implications, because a population of cells expressing Cas9 and a gRNA or a guide polynucleotide can result in a diverse array of mutations. In most cases, NHEJ gives rise to small indels in the target DNA that result in amino acid deletions, insertions, or frameshift mutations leading to premature stop codons within the open reading frame (ORF) of the targeted gene. The ideal end result is a loss-of-function mutation within the targeted gene.

While NHEJ-mediated DSB repair often disrupts the open reading frame of the gene, homology directed repair (HDR) can be used to generate specific nucleotide changes ranging from a single nucleotide change to large insertions like the addition of a fluorophore or tag.

In order to utilize HDR for gene editing, a DNA repair template containing the desired sequence can be delivered into the cell type of interest with the gRNA(s) and Cas9 or Cas9 nickase. The repair template can contain the desired edit as well as additional homologous sequence immediately upstream and downstream of the target (termed left & right homology arms). The length of each homology arm can be dependent on the size of the change being introduced, with larger insertions requiring longer homology arms. The repair template can be a single-stranded oligonucleotide, double-stranded oligonucleotide, or a double-stranded DNA plasmid. The efficiency of HDR is generally low (<10% of modified alleles) even in cells that express Cas9, gRNA and an exogenous repair template. The efficiency of HDR can be enhanced by synchronizing the cells, since HDR takes place during the S and G2 phases of the cell cycle. Chemically or genetically inhibiting genes involved in NHEJ can also increase HDR frequency.

In some embodiments, Cas9 is a modified Cas9. A given gRNA targeting sequence can have additional sites throughout the genome where partial homology exists. These sites are called off-targets and need to be considered when designing a gRNA. In addition to optimizing gRNA design, CRISPR specificity can also be increased through modifications to Cas9. Cas9 generates double-strand breaks (DSBs) through the combined activity of two nuclease domains, RuvC and HNH. Cas9 nickase, a D10A mutant of SpCas9, retains one nuclease domain and generates a DNA nick rather than a DSB. The nickase system can also be combined with HDR-mediated gene editing for specific gene edits.

In some cases, Cas9 is a variant Cas9 protein. A variant Cas9 polypeptide has an amino acid sequence that is different by one amino acid (e.g., has a deletion, insertion, substitution, fusion) when compared to the amino acid sequence of a wild type Cas9 protein. In some instances, the variant Cas9 polypeptide has an amino acid change (e.g., deletion, insertion, or substitution) that reduces the nuclease activity of the Cas9 polypeptide. For example, in some instances, the variant Cas9 polypeptide has less than 50%, less than 40%, less than 30%, less than 20%, less than 10%, less than 5%, or less than 1% of the nuclease activity of the corresponding wild-type Cas9 protein. In some cases, the variant Cas9 protein has no substantial nuclease activity. When a subject Cas9 protein is a variant Cas9 protein that has no substantial nuclease activity, it can be referred to as "dCas9." In some cases, a variant Cas9 protein has reduced nuclease activity. For example, a variant Cas9 protein exhibits less than about 20%, less than about 15%, less than about 10%, less than about 5%, less than about 1%, or less than about 0.1%, of the endonuclease activity of a wild-type Cas9 protein, e.g., a wild-type Cas9 protein.

In some cases, a variant Cas9 protein can cleave the complementary strand of a guide target sequence but has reduced ability to cleave the non-complementary strand of a double stranded guide target sequence. For example, the variant Cas9 protein can have a mutation (amino acid substitution) that reduces the function of the RuvC domain. As a non-limiting example, in some embodiments, a variant Cas9 protein has a D10A (aspartate to alanine at amino acid position 10) and can therefore cleave the complementary strand of a double stranded guide target sequence but has reduced ability to cleave the non-complementary strand of a double stranded guide target sequence (thus resulting in a single strand break (SSB) instead of a double strand break (DSB) when the variant Cas9 protein cleaves a double stranded target nucleic acid) (see, for example, Jinek et al., Science. 2012 Aug. 17; 337 (6096): 816-21).

In some cases, a variant Cas9 protein can cleave the non-complementary strand of a double stranded guide target sequence but has reduced ability to cleave the complementary strand of the guide target sequence. For example, the variant Cas9 protein can have a mutation (amino acid substitution) that reduces the function of the HNH domain (RuvC/HNH/RuvC domain motifs). As a non-limiting example, in some embodiments, the variant Cas9 protein has an H840A (histidine to alanine at amino acid position 840) mutation and can therefore cleave the non-complementary strand of the guide target sequence but has reduced ability to cleave the complementary strand of the guide target sequence (thus resulting in a SSB instead of a DSB when the variant Cas9 protein cleaves a double stranded guide target sequence). Such a Cas9 protein has a reduced ability to cleave a guide target sequence (e.g., a single stranded guide target sequence) but retains the ability to bind a guide target sequence (e.g., a single stranded guide target sequence).

In some cases, a variant Cas9 protein has a reduced ability to cleave both the complementary and the non-complementary strands of a double stranded target DNA. As a non-limiting example, in some cases, the variant Cas9 protein harbors both the D10A and the H840A mutations such that the polypeptide has a reduced ability to cleave both the complementary and the non-complementary strands of a double stranded target DNA. Such a Cas9 protein has a reduced ability to cleave a target DNA (e.g., a single stranded target DNA) but retains the ability to bind a target DNA (e.g., a single stranded target DNA).

As another non-limiting example, in some cases, the variant Cas9 protein harbors W476A and W1126A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA).

As another non-limiting example, in some cases, the variant Cas9 protein harbors P475A, W476A, N477A, D1125A, W1126A, and D1127A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA).

As another non-limiting example, in some cases, the variant Cas9 protein harbors H840A, W476A, and W1126A, mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). As another non-limiting example, in some cases, the variant Cas9 protein harbors H840A, D10A, W476A, and W1126A, mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). In some embodiments, the variant Cas9 has restored catalytic His residue at position 840 in the Cas9 HNH domain (A840H).

As another non-limiting example, in some cases, the variant Cas9 protein harbors, H840A, P475A, W476A, N477A, D1125A, W1126A, and D1127A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). As another non-limiting example, in some cases, the variant Cas9 protein harbors D10A, H840A, P475A, W476A, N477A, D1125A, W1126A, and D1127A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). In some cases, when a variant Cas9 protein harbors W476A and W1126A mutations or when the variant Cas9 protein harbors P475A, W476A, N477A, D1125A, W1126A, and D1127A mutations, the variant Cas9 protein does not bind efficiently to a PAM sequence. Thus, in some such cases, when such a variant Cas9 protein is used in a method of binding, the method does not require a PAM sequence. In other words, in some cases, when such a variant Cas9 protein is used in a method of binding, the method can include a guide RNA, but the method can be performed in the absence of a PAM sequence (and the specificity of binding is therefore provided by the targeting segment of the guide RNA). Other residues can be mutated to achieve the above effects (i.e., inactivate one or the other nuclease portions). As non-limiting examples, residues D10, G12, G17, E762, H840, N854, N863, H982, H983, A984, D986, and/or A987 can be altered (i.e., substituted). Also, mutations other than alanine substitutions are suitable.

In some embodiments, a variant Cas9 protein that has reduced catalytic activity (e.g., when a Cas9 protein has a D10, G12, G17, E762, H840, N854, N863, H982, H983, A984, D986, and/or A987 mutation, e.g., D10A, G12A, G17A, E762A, H840A, N854A, N863A, H982A, H983A, A984A, and/or D986A), the variant Cas9 protein can still bind to target DNA in a site-specific manner (because it is still guided to a target DNA sequence by a guide RNA) as long as it retains the ability to interact with the guide RNA.

In some embodiments, the variant Cas protein can be spCas9, spCas9-VRQR, spCas9-VRER, xCas9 (sp), saCas9, saCas9-KKH, spCas9-MQKSER, spCas9-LRKIQK, or spCas9-LRVSQL.

Alternatives to *S. pyogenes* Cas9 can include RNA-guided endonucleases from the Cpf1 family that display cleavage activity in mammalian cells. CRISPR from *Prevotella* and *Francisella* 1 (CRISPR/Cpf1) is a DNA-editing technology analogous to the CRISPR/Cas9 system. Cpf1 is an RNA-guided endonuclease of a class II CRISPR/Cas system. This acquired immune mechanism is found in *Prevotella* and *Francisella* bacteria. Cpf1 genes are associated with the CRISPR locus, coding for an endonuclease that use a guide RNA to find and cleave viral DNA. Cpf1 is a smaller and simpler endonuclease than Cas9, overcoming some of the CRISPR/Cas9 system limitations. Unlike Cas9 nucleases, the result of Cpf1-mediated DNA cleavage is a double-strand break with a short 3' overhang. Cpf1's staggered cleavage pattern can open up the possibility of directional gene transfer, analogous to traditional restriction enzyme cloning, which can increase the efficiency of gene editing. Like the Cas9 variants and orthologues described above, Cpf1 can also expand the number of sites that can be targeted by CRISPR to AT-rich regions or AT-rich genomes that lack the NGG PAM sites favored by SpCas9. The Cpf1 locus contains a mixed alpha/beta domain, a RuvC-I followed by a helical region, a RuvC-II and a zinc finger-like domain. The Cpf1 protein has a RuvC-like endonuclease domain that is similar to the RuvC domain of Cas9. Furthermore, Cpf1 does not have a HNH endonuclease domain, and the N-terminal of Cpf1 does not have the alpha-helical recognition lobe of Cas9. Cpf1 CRISPR-Cas domain architecture shows that Cpf1 is functionally unique, being classified as Class 2, type V CRISPR system. The Cpf1 loci encode Cas1, Cas2 and Cas4 proteins more similar to types I and III than from type II systems. Functional Cpf1 doesn't need the trans-activating CRISPR RNA (tracrRNA), therefore, only CRISPR (crRNA) is required. This benefits genome editing because Cpf1 is not only smaller than Cas9, but also it has a smaller sgRNA molecule (proximately half as many nucleotides as Cas9). The Cpf1-crRNA complex cleaves target DNA or RNA by identification of a protospacer adjacent motif 5'-YTN-3' in contrast to the G-rich PAM targeted by Cas9. After identification of PAM, Cpf1 introduces a sticky-end-like DNA double-stranded break of 4 or 5 nucleotides overhang.

Protospacer Adjacent Motif

The term "protospacer adjacent motif (PAM)" or PAM-like motif refers to a 2-6 base pair DNA sequence immediately following the DNA sequence targeted by the Cas9 nuclease in the CRISPR bacterial adaptive immune system. In some embodiments, the PAM can be a 5' PAM (i.e., located upstream of the 5' end of the protospacer). In other embodiments, the PAM can be a 3' PAM (i.e., located downstream of the 5' end of the protospacer).

The PAM sequence is essential for target binding, but the exact sequence depends on a type of Cas protein.

A base editor provided herein can comprise a CRISPR protein-derived domain that is capable of binding a nucleotide sequence that contains a canonical or non-canonical protospacer adjacent motif (PAM) sequence. A PAM site is a nucleotide sequence in proximity to a target polynucleotide sequence. Some aspects of the disclosure provide for base editors comprising all or a portion of CRISPR proteins that have different PAM specificities. For example, typically Cas9 proteins, such as Cas9 from *S. pyogenes* (spCas9), require a canonical NGG PAM sequence to bind a particular nucleic acid region, where the "N" in "NGG" is adenine (A), thymine (T), guanine (G), or cytosine (C), and the G is guanine. A PAM can be CRISPR protein-specific and can be different between different base editors comprising different CRISPR protein-derived domains. A PAM can be 5' or 3' of a target sequence. A PAM can be upstream or downstream of a target sequence. A PAM can be 1, 2, 3, 4, 5, 6, 7, 8, 9, 10 or more nucleotides in length. Often, a PAM is between 2-6 nucleotides in length. Several PAM variants are described in Table 1.

In some embodiments, the SpCas9 has specificity for PAM nucleic acid sequence 5'-NGC-3' or 5'-NGG-3'. In various embodiments of the above aspects, the SpCas9 is a Cas9 or Cas9 variant listed in Table 1. In various embodiments of the above aspects, the modified SpCas9 is spCas9-MQKFRAER. In some embodiments, the variant Cas protein can be spCas9, spCas9-VRQR, spCas9-VRER, xCas9 (sp), saCas9, saCas9-KKH, SpCas9-MQKFRAER, spCas9-MQKSER, spCas9-LRKIQK, or spCas9-LRVSQL. In one specific embodiment, a modified SpCas9 including amino acid substitutions D1135M, S1136Q, G1218K, E1219F, A1322R, D1332A, R1335E, and T1337R (SpCas9-MQKFRAER) and having specificity for the altered PAM 5'-NGC-3' is used.

In some embodiments, the PAM is NGT. In some embodiments, the NGT PAM is a variant. In some embodiments, the NGT PAM variant is created through targeted mutations at one or more residues 1335, 1337, 1135, 1136, 1218, and/or 1219. In some embodiments, the NGT PAM variant is created through targeted mutations at one or more residues 1219, 1335, 1337, 1218. In some embodiments, the NGT PAM variant is created through targeted mutations at one or more residues 1135, 1136, 1218, 1219, and 1335. In some embodiments, the NGT PAM variant is selected from the set of targeted mutations provided in Tables 2 and 3 below.

TABLE 2

NGT PAM Variant Mutations at residues 1219, 1335, 1337, 1218

| Variant | E1219V | R1335Q | T1337 | G1218 |
|---------|--------|--------|-------|-------|
| 1 | F | V | T | |
| 2 | F | V | R | |

TABLE 2-continued

NGT PAM Variant Mutations at residues 1219, 1335, 1337, 1218

| Variant | E1219V | R1335Q | T1337 | G1218 |
|---|---|---|---|---|
| 3 | F | V | Q | |
| 4 | F | V | L | |
| 5 | F | V | T | R |
| 6 | F | V | R | R |
| 7 | F | V | Q | R |
| 8 | F | V | L | R |
| 9 | L | L | T | |
| 10 | L | L | R | |
| 11 | L | L | Q | |
| 12 | L | L | L | |
| 13 | F | I | T | |
| 14 | F | I | R | |
| 15 | F | I | Q | |
| 16 | F | I | L | |
| 17 | F | G | C | |
| 18 | H | L | N | |
| 19 | F | G | C | A |
| 20 | H | L | N | V |
| 21 | L | A | W | |
| 22 | L | A | F | |
| 23 | L | A | Y | |
| 24 | I | A | W | |
| 25 | I | A | F | |
| 26 | I | A | Y | |

TABLE 3

NGT PAM Variant Mutations at residues 1135, 1136, 1218, 1219, and 1335

| Variant | D1135L | S1136R | G1218S | E1219V | R1335Q |
|---|---|---|---|---|---|
| 27 | G | | | | |
| 28 | V | | | | |
| 29 | I | | | | |
| 30 | | A | | | |
| 31 | | W | | | |
| 32 | | H | | | |
| 33 | | K | | | |
| 34 | | | K | | |
| 35 | | | R | | |
| 36 | | | Q | | |
| 37 | | | T | | |
| 38 | | | N | | |
| 39 | | | | I | |
| 40 | | | | A | |
| 41 | | | | N | |
| 42 | | | | Q | |
| 43 | | | | G | |
| 44 | | | | L | |
| 45 | | | | S | |
| 46 | | | | T | |
| 47 | | | | | L |
| 48 | | | | | I |
| 49 | | | | | V |
| 50 | | | | | N |
| 51 | | | | | S |
| 52 | | | | | T |
| 53 | | | | | F |
| 54 | | | | | Y |
| 55 | N1286Q | I1331F | | | |

In some embodiments, the NGT PAM variant is selected from variant 5, 7, 28, 31, or 36 in Tables 2 and 3. In some embodiments, the variants have improved NGT PAM recognition.

In some embodiments, the NGT PAM variants have mutations at residues 1219, 1335, 1337, and/or 1218. In some embodiments, the NGT PAM variant is selected with mutations for improved recognition from the variants provided in Table 4 below.

TABLE 4

NGT PAM Variant Mutations at residues 1219, 1335, 1337, and 1218

| Variant | E1219V | R1335Q | T1337 | G1218 |
|---|---|---|---|---|
| 1 | F | V | T | |
| 2 | F | V | R | |
| 3 | F | V | Q | |
| 4 | F | V | L | |
| 5 | F | V | T | R |
| 6 | F | V | R | R |
| 7 | F | V | Q | R |
| 8 | F | V | L | R |

In some embodiments, the NGT PAM is selected from the variants provided in Table 5 below.

TABLE 5

NGT PAM variants

| | NGTN variant | D1135 | S1136 | G1218 | E1219 | A1322R | R1335 | T1337 |
|---|---|---|---|---|---|---|---|---|
| Variant 1 | LRKIQK | L | R | K | I | — | Q | K |
| Variant 2 | LRSVQK | L | R | S | V | — | Q | K |
| Variant 3 | LRSVQL | L | R | S | V | — | Q | L |
| Variant 4 | LRKIRQK | L | R | K | I | R | Q | K |
| Variant 5 | LRSVRQK | L | R | S | V | R | Q | K |
| Variant 6 | LRSVRQL | L | R | S | V | R | Q | L |

In some embodiments, the Cas9 domain is a Cas9 domain from *Streptococcus pyogenes* (SpCas9). In some embodiments, the SpCas9 domain is a nuclease active SpCas9, a nuclease inactive SpCas9 (SpCas9d), or a SpCas9 nickase (SpCas9n). In some embodiments, the SpCas9 comprises a D9X mutation, or a corresponding mutation in any of the amino acid sequences provided herein, wherein X is any amino acid except for D. In some embodiments, the SpCas9 comprises a D9A mutation, or a corresponding mutation in any of the amino acid sequences provided herein. In some embodiments, the SpCas9 domain, the SpCas9d domain, or the SpCas9n domain can bind to a nucleic acid sequence having a non-canonical PAM. In some embodiments, the SpCas9 domain, the SpCas9d domain, or the SpCas9n domain can bind to a nucleic acid sequence having an NGG, a NGA, or a NGCG PAM sequence.

In some embodiments, the SpCas9 domain comprises one or more of a D1135X, a R1335X, and a T1336X mutation, or a corresponding mutation in any of the amino acid sequences provided herein, wherein X is any amino acid. In some embodiments, the SpCas9 domain comprises one or more of a D1135E, R1335Q, and T1336R mutation, or a corresponding mutation in any of the amino acid sequences provided herein. In some embodiments, the SpCas9 domain comprises a D1135E, a R1335Q, and a T1336R mutation, or corresponding mutations in any of the amino acid sequences provided herein. In some embodiments, the SpCas9 domain comprises one or more of a D1135X, a R1335X, and a T1336X mutation, or a corresponding mutation in any of the amino acid sequences provided herein, wherein X is any amino acid. In some embodiments, the SpCas9 domain comprises one or more of a D1135V, a R1335Q, and a T1336R mutation, or a corresponding mutation in any of the amino acid sequences provided herein. In some embodiments, the SpCas9 domain comprises a D1135V, a R1335Q, and a T1336R mutation, or corresponding mutations in any of the amino acid sequences provided herein. In some embodiments, the SpCas9 domain comprises one or more of a D1135X, a G1217X, a R1335X, and a T1336X mutation, or a corresponding mutation in any of the amino acid sequences provided herein, wherein X is any amino acid. In some embodiments, the SpCas9 domain comprises one or more of a D1135V, a G1217R, a R1335Q, and a T1336R mutation, or a corresponding mutation in any of the amino acid sequences provided herein. In some embodiments, the SpCas9 domain comprises a D1135V, a G1217R, a R1335Q, and a T1336R mutation, or corresponding mutations in any of the amino acid sequences provided herein.

In some embodiments, the Cas9 domains of any of the fusion proteins provided herein comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to a Cas9 polypeptide described herein. In some embodiments, the Cas9 domains of any of the fusion proteins provided herein comprises the amino acid sequence of any Cas9 polypeptide described herein. In some embodiments, the Cas9 domains of any of the fusion proteins provided herein consists of the amino acid sequence of any Cas9 polypeptide described herein.

In some examples, a PAM recognized by a CRISPR protein-derived domain of a base editor disclosed herein can be provided to a cell on a separate oligonucleotide to an insert (e.g., an AAV insert) encoding the base editor. In such embodiments, providing PAM on a separate oligonucleotide can allow cleavage of a target sequence that otherwise would not be able to be cleaved, because no adjacent PAM is present on the same polynucleotide as the target sequence.

In an embodiment, *S. pyogenes* Cas9 (SpCas9) can be used as a CRISPR endonuclease for genome engineering. However, others can be used. In some embodiments, a different endonuclease can be used to target certain genomic targets. In some embodiments, synthetic SpCas9-derived variants with non-NGG PAM sequences can be used. Additionally, other Cas9 orthologues from various species have been identified and these "non-SpCas9s" can bind a variety of PAM sequences that can also be useful for the present disclosure. For example, the relatively large size of SpCas9 (approximately 4 kilobase (kb) coding sequence) can lead to plasmids carrying the SpCas9 cDNA that cannot be efficiently expressed in a cell. Conversely, the coding sequence for *Staphylococcus aureus* Cas9 (SaCas9) is approximately 1 kilobase shorter than SpCas9, possibly allowing it to be efficiently expressed in a cell. Similar to SpCas9, the SaCas9 endonuclease is capable of modifying target genes in mammalian cells in vitro and in mice in vivo. In some embodiments, a Cas protein can target a different PAM sequence. In some embodiments, a target gene can be adjacent to a Cas9 PAM, 5'-NGG, for example. In other embodiments, other Cas9 orthologs can have different PAM requirements. For example, other PAMs such as those of *S. thermophilus* (5'-NNAGAA for CRISPR1 and 5'-NGGNG for CRISPR3) and *Neisseria* meningitidis (5'-NNNNGATT) can also be found adjacent to a target gene.

In some embodiments, for a *S. pyogenes* system, a target gene sequence can precede (i.e., be 5' to) a 5'-NGG PAM, and a 20-nt guide RNA sequence can base pair with an opposite strand to mediate a Cas9 cleavage adjacent to a PAM. In some embodiments, an adjacent cut can be or can be about 3 base pairs upstream of a PAM. In some embodiments, an adjacent cut can be or can be about 10 base pairs upstream of a PAM. In some embodiments, an adjacent cut can be or can be about 0-20 base pairs upstream of a PAM. For example, an adjacent cut can be next to, 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 base pairs upstream of a PAM. An adjacent cut can also be downstream of a PAM by 1 to 30 base pairs. The sequences of exemplary SpCas9 proteins capable of binding a PAM sequence follow:

```
The amino acid sequence of an exemplary PAM-binding SpCas9 is
as follows:
                                                  (SEQ ID NO: 104)
MDKKYSIGLDIGTNSVGWAVITDEYKVPSKKFKVLGNTDRHSIKKNLIGALLFDSGETAEAT

RLKRTARRRYTRRKNRICYLQEIFSNEMAKVDDSFFHRLEESFLVEEDKKHERHPIFGNIVD

EVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGL

TPNFKSNFDLAEDAKLQLSKDTYDDDLDNLLAQIGDQYADLFLAAKNLSDAILLSDILRVNT
```

-continued

```
EITKAPLSASMIKRYDEHHQDLTLLKALVRQQLPEKYKEIFFDQSKNGYAGYIDGGASQEEF

YKFIKPILEKMDGTEELLVKLNREDLLRKQRTFDNGSIPHQIHLGELHAILRRQEDFYPFLK

DNREKIEKILTFRIPYYVGPLARGNSRFAWMTRKSEETITPWNFEEVVDKGASAQSFIERMT

NFDKNLPNEKVLPKHSLLYEYFTVYNELTKVKYVTEGMRKPAFLSGEQKKAIVDLLFKTNRK

VTVKQLKEDYFKKIECFDSVEISGVEDRFNASLGTYHDLLKIIKDKDFLDNEENEDILEDIV

LTLTLFEDREMIEERLKTYAHLFDDKVMKQLRRRYTGWGRLSRKLINGIRDKQSGKTILDF

LKSDGFANRNFMQLIHDDSLTFKEDIQKAQVSGQGDSLHEHIANLAGSPAIKKGILQTVKVV

DELVKVMGRHKPENIVIEMARENQTTQKGQKNSRERMKRIEEGIKELGSQILKEHPVENTQL

QNEKLYLYYLQNGRDMYVDQELDINRLSDYDVDHIVPQSFLKDDSIDNKVLTRSDKNRGKSD

NVPSEEVVKKMKNYWRQLLNAKLITQRKFDNLTKAERGGLSELDKAGFIKRQLVETRQITKH

VAQILDSRMNTKYDENDKLIREVKVITLKSKLVSDFRKDFQFYKVREINNYHHAHDAYLNAV

VGTALIKKYPKLESEFVYGDYKVYDVRKMIAKSEQEIGKATAKYFFYSNIMNFFKTEITLAN

GEIRKRPLIETNGETGEIVWDKGRDFATVRKVLSMPQVNIVKKTEVQTGGFSKESILPKRNS

DKLIARKKDWDPKKYGGFDSPTVAYSVLVVAKVEKGKSKKLKSVKELLGITIMERSSFEKNP

IDFLEAKGYKEVKKDLIIKLPKYSLFELENGRKRMLASAGELQKGNELALPSKYVNFLYLAS

HYEKLKGSPEDNEQKQLFVEQHKHYLDEIIEQISEFSKRVILADANLDKVLSAYNKHRDKPI

REQAENIIHLFTLTNLGAPAAFKYFDTTIDRKRYTSTKEVLDATLIHQSITGLYETRIDLSQ

LGGD.
```

The amino acid sequence of an exemplary PAM-binding SpCas9n is as follows:

(SEQ ID NO: 14)

```
MDKKYSIGLAIGTNSVGWAVITDEYKVPSKKFKVLGNTDRHSIKKNLIGALLFDSGETAEAT

RLKRTARRRYTRRKNRICYLQEIFSNEMAKVDDSFFHRLEESFLVEEDKKHERHPIFGNIVD

EVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGL

TPNFKSNFDLAEDAKLQLSKDTYDDDLDNLLAQIGDQYADLFLAAKNLSDAILLSDILRVNT

EITKAPLSASMIKRYDEHHQDLTLLKALVRQQLPEKYKEIFFDQSKNGYAGYIDGGASQEEF

YKFIKPILEKMDGTEELLVKLNREDLLRKQRTFDNGSIPHQIHLGELHAILRRQEDFYPFLK

DNREKIEKILTFRIPYYVGPLARGNSRFAWMTRKSEETITPWNFEEVVDKGASAQSFIERMT

NFDKNLPNEKVLPKHSLLYEYFTVYNELTKVKYVTEGMRKPAFLSGEQKKAIVDLLFKTNRK

VTVKQLKEDYFKKIECFDSVEISGVEDRFNASLGTYHDLLKIIKDKDFLDNEENEDILEDIV

LTLTLFEDREMIEERLKTYAHLFDDKVMKQLRRRYTGWGRLSRKLINGIRDKQSGKTILDF

LKSDGFANRNFMQLIHDDSLTFKEDIQKAQVSGQGDSLHEHIANLAGSPAIKKGILQTVKVV

DELVKVMGRHKPENIVIEMARENQTTQKGQKNSRERMKRIEEGIKELGSQILKEHPVENTQL

QNEKLYLYYLQNGRDMYVDQELDINRLSDYDVDHIVPQSFLKDDSIDNKVLTRSDKNRGKSD

NVPSEEVVKKMKNYWRQLLNAKLITQRKFDNLTKAERGGLSELDKAGFIKRQLVETRQITKH

VAQILDSRMNTKYDENDKLIREVKVITLKSKLVSDFRKDFQFYKVREINNYHHAHDAYLNAV

VGTALIKKYPKLESEFVYGDYKVYDVRKMIAKSEQEIGKATAKYFFYSNIMNFFKTEITLAN

GEIRKRPLIETNGETGEIVWDKGRDFATVRKVLSMPQVNIVKKTEVQTGGFSKESILPKRNS

DKLIARKKDWDPKKYGGFDSPTVAYSVLVVAKVEKGKSKKLKSVKELLGITIMERSSFEKNP

IDFLEAKGYKEVKKDLIIKLPKYSLFELENGRKRMLASAGELQKGNELALPSKYVNFLYLAS
```

-continued

HYEKLKGSPEDNEQKQLFVEQHKHYLDEIIEQISEFSKRVILADANLDKVLSAYNKHRDKPI

REQAENIIHLFTLTNLGAPAAFKYFDTTIDRKRYTSTKEVLDATLIHQSITGLYETRIDLSQ

LGGD.

The amino acid sequence of an exemplary PAM-binding SpEQR Cas9 is
as follows:
(SEQ ID NO: 105)
MDKKYSIGLAIGTNSVGWAVITDEYKVPSKKFKVLGNTDRHSIKKNLIGALLFDSGETAEAT

RLKRTARRRYTRRKNRICYLQEIFSNEMAKVDDSFFHRLEESFVEEDKKHERHPIFGNIVDE

VAYHEKYPTIYHLRKKLVDSTDKADLRLIYLALAHMIKFRGHFLIEGDLNPDNSDVDKLFIQ

LVQTYNQLFEENPINASGVDAKAILSARLSKSRRLENLIAQLPGEKKNGLFGNLIALSLGLT

PNFKSNFDLAEDAKLQLSKDTYDDDLDNLLAQIGDQYADLFLAAKNLSDAILLSDILRVNTE

ITKAPLSASMIKRYDEHHQDLTLLKALVRQQLPEKYKEIFFDQSKNGYAGYIDGGASQEEFY

KFIKPILEKMDGTEELLVKLNREDLLRKQRTFDNGSIPHQIHLGELHAILRRQEDFYPFLKD

NREKIEKILTFRIPYYVGPLARGNSRFAWMTRKSEETITPWNFEEVVDKGASAQSFIERMTN

FDKNLPNEKVLPKHSLLYEYFTVYNELTKVKYVTEGMRKPAFLSGEQKKAIVDLLFKTNRKV

TVKQLKEDYFKKIECFDSVEISGVEDRFNASLGTYHDLLKIIKDKDFLDNEENEDILEDIVL

TLTLFEDREMIEERLKTYAHLFDDKVMKQLKRRRYTGWGRLSRKLINGIRDKQSGKTILDFL

KSDGFANRNFMQLIHDDSLTFKEDIQKAQVSGQGDSLHEHIANLAGSPAIKKGILQTVKVVD

ELVKVMGRHKPENIVIEMARENQTTQKGQKNSRERMKRIEEGIKELGSQILKEHPVENTQLQ

NEKLYLYYLQNGRDMYVDQELDINRLSDYDVDHIVPQSFLKDDSIDNKVLTRSDKNRGKSDN

VPSEEVVKKMKNYWRQLLNAKLITQRKFDNLTKAERGGLSELDKAGFIKRQLVETRQITKHV

AQILDSRMNTKYDENDKLIREVKVITLKSKLVSDFRKDFQFYKVREINNYHHAHDAYLNAVV

GTALIKKYPKLESEFVYGDYKVYDVRKMIAKSEQEIGKATAKYFFYSNIMNFFKTEITLANG

EIRKRPLIETNGETGEIVWDKGRDFATVRKVLSMPQVNIVKKTEVQTGGFSKESILPKRNSD

KLIARKKDWDPKKYGGFESPTVAYSVLVVAKVEKGKSKKLKSVKELLGITIMERSSFEKNPI

DFLEAKGYKEVKKDLIIKLPKYSLFELENGRKRMLASAGELQKGNELALPSKYVNFLYLASH

YEKLKGSPEDNEQKQLFVEQHKHYLDEIIEQISEFSKRVILADANLDKVLSAYNKHRDKPIR

EQAENIIHLFTLTNLGAPAAFKYFDTTIDRKQYRSTKEVLDATLIHQSITGLYETRIDLSQL

GGD.

In this sequence, residues E1135, Q1335 and R1337, which
can be mutated from D1135, R1335, and T1337 to yield a SpEQR
Cas9, are underlined and in bold.

The amino acid sequence of an exemplary PAM-binding SpVQR Cas9 is
as follows:
(SEQ ID NO: 106)
MDKKYSIGLAIGTNSVGWAVITDEYKVPSKKFKVLGNTDRHSIKKNLIGALLFDSGETAEAT

RLKRTARRRYTRRKNRICYLQEIFSNEMAKVDDSFFHRLEESFLVEEDKKHERHPIFGNIVD

EVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGL

TPNFKSNFDLAEDAKLQLSKDTYDDDLDNLLAQIGDQYADLFLAAKNLSDAILLSDILRVNT

EITKAPLSASMIKRYDEHHQDLTLLKALVRQQLPEKYKEIFFDQSKNGYAGYIDGGASQEEF

YKFIKPILEKMDGTEELLVKLNREDLLRKQRTFDNGSIPHQIHLGELHAILRRQEDFYPFLK

DNREKIEKILTFRIPYYVGPLARGNSRFAWMTRKSEETITPWNFEEVVDKGASAQSFIERMT

NFDKNLPNEKVLPKHSLLYEYFTVYNELTKVKYVTEGMRKPAFLSGEQKKAIVDLLFKTNRK

VTVKQLKEDYFKKIECFDSVEISGVEDRFNASLGTYHDLLKIIKDKDFLDNEENEDILEDIV

```
LTLTLFEDREMIEERLKTYAHLEDDKVMKQLKRRRYTGWGRLSRKLINGIRDKQSGKTILDF

LKSDGFANRNFMQLIHDDSLTFKEDIQKAQVSGQGDSLHEHIANLAGSPAIKKGILQTVKVV

DELVKVMGRHKPENIVIEMARENQTTQKGQKNSRERMKRIEEGIKELGSQILKEHPVENTQL

QNEKLYLYYLQNGRDMYVDQELDINRLSDYDVDHIVPQSFLKDDSIDNKVLTRSDKNRGKSD

NVPSEEVVKKMKNYWRQLLNAKLITQRKFDNLTKAERGGLSELDKAGFIKRQLVETRQITKH

VAQILDSRMNTKYDENDKLIREVKVITLKSKLVSDFRKDFQFYKVREINNYHHAHDAYLNAV

VGTALIKKYPKLESEFVYGDYKVYDVRKMIAKSEQEIGKATAKYFFYSNIMNFFKTEITLAN

GEIRKRPLIETNGETGEIVWDKGRDFATVRKVLSMPQVNIVKKTEVQTGGFSKESILPKRNS

DKLIARKKDWDPKKYGGFVSPTVAYSVLVVAKVEKGKSKKLKSVKELLGITIMERSSFEKNP

IDFLEAKGYKEVKKDLIIKLPKYSLFELENGRKRMLASAGELQKGNELALPSKYVNFLYLAS

HYEKLKGSPEDNEQKQLFVEQHKHYLDEIIEQISEFSKRVILADANLDKVLSAYNKHRDKPI

REQAENIIHLFTLTNLGAPAAFKYFDTTIDRKQYRSTKEVLDATLIHQSITGLYETRIDLSQ

LGGD.
In this sequence, residues V1135, Q1335, and R1336,
which can be mutated from D1135, R1335, and T1336 to yield a
SpVQR Cas9, are underlined and in bold.

The amino acid sequence of an exemplary PAM-binding SpVRER Cas9 is
as follows:
                                                    (SEQ ID NO: 107)
MDKKYSIGLAIGTNSVGWAVITDEYKVPSKKFKVLGNTDRHSIKKNLIGALLFDSGETAEAT

RLKRTARRRYTRRKNRICYLQEIFSNEMAKVDDSFFHRLEESFLVEEDKKHERHPIFGNIVD

EVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGL

TPNFKSNFDLAEDAKLQLSKDTYDDDLDNLLAQIGDQYADLFLAAKNLSDAILLSDILRVNT

EITKAPLSASMIKRYDEHHQDLTLLKALVRQQLPEKYKEIFFDQSKNGYAGYIDGGASQEEF

YKFIKPILEKMDGTEELLVKLNREDLLRKQRTFDNGSIPHQIHLGELHAILRRQEDFYPFLK

DNREKIEKILTFRIPYYVGPLARGNSRFAWMTRKSEETITPWNFEEVVDKGASAQSFIERMT

NFDKNLPNEKVLPKHSLLYEYFTVYNELTKVKYVTEGMRKPAFLSGEQKKAIVDLLFKTNRK

VTVKQLKEDYFKKIECFDSVEISGVEDRFNASLGTYHDLLKIIKDKDFLDNEENEDILEDIV

LTLTLFEDREMIEERLKTYAHLFDDKVMKQLKRRRYTGWGRLSRKLINGIRDKQSGKTILDF

LKSDGFANRNFMQLIHDDSLTFKEDIQKAQVSGQGDSLHEHIANLAGSPAIKKGILQTVKVV

DELVKVMGRHKPENIVIEMARENQTTQKGQKNSRERMKRIEEGIKELGSQILKEHPVENTQL

QNEKLYLYYLQNGRDMYVDQELDINRLSDYDVDHIVPQSFLKDDSIDNKVLTRSDKNRGKSD

NVPSEEVVKKMKNYWRQLLNAKLITQRKFDNLTKAERGGLSELDKAGFIKRQLVETRQITKH

VAQILDSRMNTKYDENDKLIREVKVITLKSKLVSDFRKDFQFYKVREINNYHHAHDAYLNAV

VGTALIKKYPKLESEFVYGDYKVYDVRKMIAKSEQEIGKATAKYFFYSNIMNFFKTEITLAN

GEIRKRPLIETNGETGEIVWDKGRDFATVRKVLSMPQVNIVKKTEVQTGGFSKESILPKRNS

DKLIARKKDWDPKKYGGFVSPTVAYSVLVVAKVEKGKSKKLKSVKELLGITIMERSSFEKNP

IDFLEAKGYKEVKKDLIIKLPKYSLFELENGRKRMLASARELQKGNELALPSKYVNFLYLAS

HYEKLKGSPEDNEQKQLFVEQHKHYLDEIIEQISEFSKRVILADANLDKVLSAYNKHRDKPI

REQAENIIHLFTLTNLGAPAAFKYFDTTIDRKEYRSTKEVLDATLIHQSITGLYETRIDLSQ

LGGD.
```

In some embodiments, the Cas9 domain is a recombinant Cas9 domain. In some embodiments, the recombinant Cas9 domain is a SpyMacCas9 domain. In some embodiments, the Spy MacCas9 domain is a nuclease active SpyMacCas9, a nuclease inactive SpyMacCas9 (SpyMacCas9d), or a Spy-MacCas9 nickase (SpyMacCas9n). In some embodiments, the SaCas9 domain, the SaCas9d domain, or the SaCas9n domain can bind to a nucleic acid sequence having a non-canonical PAM. In some embodiments, the SpyMac-Cas9 domain, the SpCas9d domain, or the SpCas9n domain can bind to a nucleic acid sequence having a NAA PAM sequence.

Exemplary SpyMacCas9
(SEQ ID NO: 108)
MDKKYSIGLDIGTNSVGWAVITDDYKVPSKKFKVLGNTDRHSIKKNLIGA

LLFGSGETAEATRLKRTARRRYTRRKNRICYLQEIFSNEMAKVDDSFFHR

LEESFLVEEDKKHERHPIFGNIVDEVAYHEKYPTIYHLRKKLADSTDKAD

LRLIYLALAHMIKERGHFLIEGDLNPDNSDVDKLFIQLVQIYNQLFEENP

INASRVDAKAILSARLSKSRRLENLIAQLPGEKRNGLFGNLIALSLGLTP

NFKSNFDLAEDAKLQLSKDTYDDDLDNLLAQIGDQYADLFLAAKNLSDAI

LLSDILRVNSEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGAYHDLLKI

IKDKDFLDNEENEDILEDIVLTLTLFEDRGMIEERLKTYAHLFDDKVMKQ

LKRRRYTGWGRLSRKLINGIRDKQSGKTILDFLKSDGFANRNFMQLIHDD

SLTFKEDIQKAQVSGQGHSLHEQIANLAGSPAIKKGILQTVKIVDELVKV

MGHKPENIVIEMARENQTTQKGQKNSRERMKRIEEGIKELGSQILKEHPV

ENTQLQNEKLYLYYLQNGRDMYVDQELDINRLSDYDVDHIVPQSFIKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEIQ

TVGQNGGLFDDNPKSPLEVTPSKLVPLKKELNPKKYGGYQKPTTAYPVLL

ITDTKQLIPISVMNKKQFEQNPVKFLRDRGYQQVGKNDFIKLPKYTLVDI

GDGIKRLWASSKEIHKGNQLVVSKKSQILLYHAHHLDSDLSNDYLQNHNQ

QFDVLFNEIISFSKKCKLGKEHIQKIENVYSNKKNSASIEELAESFIKLL

GFTQLGATSPFNFLGVKLNQKQYKGKKDYILPCTEGTLIRQSITGLYETR

VDLSKIGED.

In some cases, a variant Cas9 protein harbors, H840A, P475A, W476A, N477A, D1125A, W1126A, and D1218A mutations such that the polypeptide has a reduced ability to cleave a target DNA or RNA. Such a Cas9 protein has a reduced ability to cleave a target DNA (e.g., a single stranded target DNA) but retains the ability to bind a target DNA (e.g., a single stranded target DNA). As another non-limiting example, in some cases, the variant Cas9 protein harbors D10A, H840A, P475A, W476A, N477A, D1125A, W1126A, and D1218A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). In some cases, when a variant Cas9 protein harbors W476A and W1126A mutations or when the variant Cas9 protein harbors P475A, W476A, N477A, D1125A, W1126A, and D1218A mutations, the variant Cas9 protein does not bind efficiently to a PAM sequence. Thus, in some such cases, when such a variant Cas9 protein is used in a method of binding, the method does not require a PAM sequence. In other words, in some cases, when such a variant Cas9 protein is used in a method of binding, the method can include a guide RNA, but the method can be performed in the absence of a PAM sequence (and the specificity of binding is therefore provided by the targeting segment of the guide RNA). Other residues can be mutated to achieve the above effects (i.e., inactivate one or the other nuclease portions). As non-limiting examples, residues D10, G12, G17, E762, H840, N854, N863, H982, H983, A984, D986, and/or A987 can be altered (i.e., substituted). Also, mutations other than alanine substitutions are suitable.

In some embodiments, a CRISPR protein-derived domain of a base editor can comprise all or a portion of a Cas9 protein with a canonical PAM sequence (NGG). In other embodiments, a Cas9-derived domain of a base editor can employ a non-canonical PAM sequence. Such sequences have been described in the art and would be apparent to the skilled artisan. For example, Cas9 domains that bind non-canonical PAM sequences have been described in Kleinstiver, B. P., et al., "Engineered CRISPR-Cas9 nucleases with altered PAM specificities" Nature 523, 481-485 (2015); and Kleinstiver, B. P., et al., "Broadening the targeting range of *Staphylococcus aureus* CRISPR-Cas9 by modifying PAM recognition" Nature Biotechnology 33, 1293-1298 (2015); the entire contents of each are hereby incorporated by reference.

Fusion Proteins Comprising a Nuclear Localization Sequence (NLS)

In some embodiments, the fusion proteins provided herein further comprise one or more (e.g., 2, 3, 4, 5) nuclear targeting sequences, for example a nuclear localization sequence (NLS). In one embodiment, a bipartite NLS is used. In some embodiments, a NLS comprises an amino acid sequence that facilitates the importation of a protein, that comprises an NLS, into the cell nucleus (e.g., by nuclear transport). In some embodiments, any of the fusion proteins provided herein further comprise a nuclear localization sequence (NLS). In some embodiments, the NLS is fused to the N-terminus of the fusion protein. In some embodiments, the NLS is fused to the C-terminus of the fusion protein. In some embodiments, the NLS is fused to the N-terminus of the Cas9 domain. In some embodiments, the NLS is fused to the C-terminus of an nCas9 domain or a dCas9 domain. In some embodiments, the NLS is fused to the N-terminus of the deaminase. In some embodiments, the NLS is fused to the C-terminus of the deaminase. In some embodiments, the NLS is fused to the fusion protein via one or more linkers. In some embodiments, the NLS is fused to the fusion protein without a linker. In some embodiments, the NLS comprises an amino acid sequence of any one of the NLS sequences provided or referenced herein. Additional nuclear localization sequences are known in the art and would be apparent to the skilled artisan. For example, NLS sequences are described in Plank et al., PCT/EP2000/011690, the contents of which are incorporated herein by reference for their disclosure of exemplary nuclear localization sequences. In some embodiments, an NLS comprises the amino acid sequence PKKKRKVEGADKRTADGSEFES PKKKRKV (SEQ ID NO: 109), KRTADGSEFESPKKKRKV (SEQ ID NO: 87), KRPAATKKAGQAKKKK (SEQ ID NO: 88), KKTELQTTNAENKTKKL (SEQ ID NO: 89), KRGINDRNFWRGENGRKTR (SEQ ID NO: 90), RKSGKIAAIVVKRPRKPKKKRKV (SEQ ID NO: 110), or MDSLLMNRRKFLYQFKNVRWAKGRRETYLC (SEQ ID NO: 93). In some embodiments, the NLS is present in a linker or the NLS is flanked by linkers, for example, the linkers described herein. In some embodiments, the N-terminus or C-terminus NLS is a bipartite NLS. A bipartite NLS comprises two basic amino acid clusters, which are separated by a relatively short spacer sequence (hence bipartite~2 parts, while monopartite NLSs are not). The NLS of nucleoplasmin, KR [PAATKKAGQA] KKKK (SEQ ID NO: 111), is the prototype of the ubiquitous bipartite signal: two clusters of basic amino acids, separated by a spacer of about 10 amino acids. The sequence of an exemplary bipartite NLS follows:

PKKKRKVEGADKRTADGSEFES PKKKRKV (SEQ ID NO: 109)

In some embodiments, the fusion proteins of the invention do not comprise a linker sequence. In some embodiments, linker sequences between one or more of the domains or proteins are present.

It should be appreciated that the fusion proteins of the present disclosure may comprise one or more additional features. For example, in some embodiments, the fusion protein may comprise inhibitors, cytoplasmic localization sequences, export sequences, such as nuclear export sequences, or other localization sequences, as well as sequence tags that are useful for solubilization, purification, or detection of the fusion proteins. Suitable protein tags provided herein include, but are not limited to, biotin carboxylase carrier protein (BCCP) tags, myc-tags, calmodulin-tags, FLAG-tags, hemagglutinin (HA)-tags, polyhistidine tags, also referred to as histidine tags or His-tags, maltose binding protein (MBP)-tags, nus-tags, glutathione-S-transferase (GST)-tags, green fluorescent protein (GFP)-tags, thioredoxin-tags, S-tags, Softags (e.g., Softag 1, Softag 3), strep-tags, biotin ligase tags, FLASH tags, V5 tags, and SBP-tags. Additional suitable sequences will be apparent to those of skill in the art. In some embodiments, the fusion protein comprises one or more His tags.

Linkers

In certain embodiments, linkers may be used to link any of the peptides or peptide domains of the invention. The linker may be as simple as a covalent bond, or it may be a polymeric linker many atoms in length. The linker may be a peptide linker or a non-peptide linker. In certain embodiments, the linker may be a UV-cleavable linker. In some embodiments, the linker may be a polynucleotide linker, e.g. a RNA linker. In certain embodiments, the linker is a polypeptide or based on amino acids. In other embodiments, the linker is not peptide-like. In certain embodiments, the linker is a covalent bond (e.g., a carbon-carbon bond, disulfide bond, carbon-heteroatom bond, etc.). In certain embodiments, the linker is a carbon-nitrogen bond of an amide linkage. In certain embodiments, the linker is a cyclic or acyclic, substituted or unsubstituted, branched or unbranched aliphatic or heteroaliphatic linker. In certain embodiments, the linker is polymeric (e.g., polyethylene, polyethylene glycol, polyamide, polyester, etc.). In certain embodiments, the linker comprises a monomer, dimer, or polymer of aminoalkanoic acid. In certain embodiments, the linker comprises an aminoalkanoic acid (e.g., glycine, ethanoic acid, alanine, beta-alanine, 3-aminopropanoic acid, 4-aminobutanoic acid, 5-pentanoic acid, etc.). In certain embodiments, the linker comprises a monomer, dimer, or polymer of aminohexanoic acid (Ahx). In certain embodiments, the linker is based on a carbocyclic moiety (e.g., cyclopentane, cyclohexane). In other embodiments, the linker comprises a polyethylene glycol moiety (PEG). In other embodiments, the linker comprises amino acids. In certain embodiments, the linker comprises a peptide. In certain embodiments, the linker comprises an aryl or heteroaryl moiety. In certain embodiments, the linker is based on a phenyl ring. The linker may include functionalized moieties to facilitate attachment of a nucleophile (e.g., thiol, amino) from the peptide to the linker. Any electrophile may be used as part of the linker. Exemplary electrophiles include, but are not limited to, activated esters, activated amides, Michael acceptors, alkyl halides, aryl halides, acyl halides, and isothiocyanates.

In some embodiments, the linker is an amino acid or a plurality of amino acids (e.g., a peptide or protein). In some embodiments, the linker is a bond (e.g., a covalent bond), an organic molecule, group, polymer, or chemical moiety. In some embodiments, the linker is about 3 to about 104 (e.g., 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 55, 60, 61, 62, 63, 64, 65, 70, 75, 80, 85, 90, 95, or 100) amino acids in length.

Cas9 Complexes with Guide RNAs

Some aspects of this disclosure provide complexes comprising any of the fusion proteins provided herein, and a guide RNA can be employed (e.g., ranging from very flexible linkers of the form $(GGGS)_n$ (SEQ ID NO: 112), $(GGGGS)_n$ (SEQ ID NO: 113), and $(G)_n$ to more rigid linkers of the form (EAAAK), (SEQ ID NO: 114), (SGGS), (SEQ ID NO: 115), SGSETPGTSESATPES (SEQ ID NO: 71) (see, e.g., Guilinger JP, Thompson DB, Liu DR.

Fusion of catalytically inactive Cas9 to FokI nuclease improves the specificity of genome modification. Nat. Biotechnol. 2014; 32 (6): 577-82; the entire contents are incorporated herein by reference) and (XP) n) in order to achieve the optimal length for activity for the nucleobase editor. In some embodiments, n is 1, 2, 3, 4, 5, 6, 7, 8, 9, 10, 11, 12, 13, 14, or 15. In some embodiments, the linker comprises a (GGS), motif, wherein n is 1, 3, or 7 (SEQ ID NO: 116). In some embodiments, the Cas9 domain of the fusion proteins provided herein are fused via a linker comprising the amino acid sequence SGSETPGTSESATPES (SEQ ID NO: 71):

In some embodiments, the guide nucleic acid (e.g., guide RNA) is from 15-100 nucleotides long and comprises a sequence of at least 10 contiguous nucleotides that is complementary to a target sequence. In some embodiments, the guide RNA is 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides long. In some embodiments, the guide RNA comprises a sequence of 15, 16, 17, 18, 19, 20, 21, 22, 23, 24, 25, 26, 27, 28, 29, 30, 31, 32, 33, 34, 35, 36, 37, 38, 39, or 40 contiguous nucleotides that is complementary to a target sequence. In some embodiments, the target sequence is a DNA sequence. In some embodiments, the target sequence is a sequence in the genome of a bacteria, yeast, fungi, insect, plant, or animal. In some embodiments, the target sequence is a sequence in the genome of a human. In some embodiments, the 3' end of the target sequence is immediately adjacent to a canonical PAM sequence (NGG). In some embodiments, the 3' end of the target sequence is immediately adjacent to a non-canonical PAM sequence (e.g., a sequence listed in Table 1). In some embodiments, the guide nucleic acid (e.g., guide RNA) is complementary to a sequence associated with a disease or disorder.

Some aspects of this disclosure provide methods of using the fusion proteins, or complexes provided herein. For example, some aspects of this disclosure provide methods comprising contacting a DNA molecule with any of the fusion proteins provided herein, and with at least one guide RNA, wherein the guide RNA is about 15-100 nucleotides long and comprises a sequence of at least 10 contiguous nucleotides that is complementary to a target sequence. In some embodiments, the 3' end of the target sequence is immediately adjacent to an AGC, GAG, TTT, GTG, or CAA sequence. In some embodiments, the 3' end of the target sequence is immediately adjacent to an NGA, NGCG, NGN, NNGRRT, NNNRRT, NGCG, NGCN, NGTN, NGTN, NGTN, or 5' (TTTV) sequence.

In some embodiments, a fusion protein of the invention is used for mutagenizing a target of interest. These mutations may affect the function of the target. For example, when a nucleobase editor is used to target a regulatory region the function of the regulatory region is altered and the expression of the downstream protein is reduced.

It will be understood that the numbering of the specific positions or residues in the respective sequences depends on the particular protein and numbering scheme used. Numbering might be different, e.g., in precursors of a mature protein and the mature protein itself, and differences in sequences from species to species may affect numbering. One of skill in the art will be able to identify the respective residue in any homologous protein and in the respective encoding nucleic acid by methods well known in the art, e.g., by sequence alignment and determination of homologous residues.

It will be apparent to those of skill in the art that in order to target any of the fusion proteins disclosed herein, to a target site, e.g., a site comprising a mutation to be edited, it is typically necessary to co-express the fusion protein together with a guide RNA. As explained in more detail elsewhere herein, a guide RNA typically comprises a tracrRNA framework allowing for Cas9 binding, and a guide sequence, which confers sequence specificity to the Cas9: nucleic acid editing enzyme/domain fusion protein. Alternatively, the guide RNA and tracrRNA may be provided separately, as two nucleic acid molecules. In some embodiments, the guide RNA comprises a structure, wherein the guide sequence comprises a sequence that is complementary to the target sequence. The guide sequence is typically 20 nucleotides long. The sequences of suitable guide RNAs for targeting Cas9: nucleic acid editing enzyme/domain fusion proteins to specific genomic target sites will be apparent to those of skill in the art based on the instant disclosure. Such suitable guide RNA sequences typically comprise guide sequences that are complementary to a nucleic sequence within 50 nucleotides upstream or downstream of the target nucleotide to be edited. Some exemplary guide RNA sequences suitable for targeting any of the provided fusion proteins to specific target sequences are provided herein.

Methods of Using Fusion Proteins Comprising a Cytidine Deaminase, Adenosine Deaminase and a Cas9 Domain Some aspects of this disclosure provide methods of using the fusion proteins, or complexes provided herein. For example, some aspects of this disclosure provide methods comprising contacting a DNA molecule with any of the fusion proteins provided herein, and with at least one guide RNA, wherein the guide RNA is about 15-100 nucleotides long and comprises a sequence of at least 10 contiguous nucleotides that is complementary to a target sequence. In some embodiments, the 3' end of the target sequence is immediately adjacent to a canonical PAM sequence (NGG). In some embodiments, the 3' end of the target sequence is not immediately adjacent to a canonical PAM sequence (NGG). In some embodiments, the 3' end of the target sequence is immediately adjacent to an AGC, GAG, TTT, GTG, or CAA sequence. In some embodiments, the 3' end of the target sequence is immediately adjacent to an NGA, NGCG, NGN, NNGRRT, NNNRRT, NGCG, NGCN, NGTN, NGTN, NGTN, or 5' (TTTV) sequence.

In some embodiments, a fusion protein of the invention is used for mutagenizing a target of interest. In particular, a multi-effector nucleobase editor described herein is capable of making multiple mutations within a target sequence. These mutations may affect the function of the target. For example, when a multi-effector nucleobase editor is used to target a regulatory region the function of the regulatory region is altered and the expression of the downstream protein is reduced.

It will be understood that the numbering of the specific positions or residues in the respective sequences depends on the particular protein and numbering scheme used. Numbering might be different, e.g., in precursors of a mature protein and the mature protein itself, and differences in sequences from species to species may affect numbering. One of skill in the art will be able to identify the respective residue in any homologous protein and in the respective encoding nucleic acid by methods well known in the art, e.g., by sequence alignment and determination of homologous residues.

It will be apparent to those of skill in the art that in order to target any of the fusion proteins comprising a Cas9 domain and a cytidine deaminase or an adenosine deaminase, as disclosed herein, to a target site, e.g., a site comprising a mutation to be edited, it is typically necessary to co-express the fusion protein together with a guide RNA, e.g., an sgRNA. As explained in more detail elsewhere herein, a guide RNA typically comprises a tracrRNA framework allowing for Cas9 binding, and a guide sequence, which confers sequence specificity to the Cas9: nucleic acid editing enzyme/domain fusion protein. Alternatively, the guide RNA and tracrRNA may be provided separately, as two nucleic acid molecules. In some embodiments, the guide RNA comprises a structure, wherein the guide sequence comprises a sequence that is complementary to the target sequence. The guide sequence is typically 20 nucleotides long. The sequences of suitable guide RNAs for targeting Cas9: nucleic acid editing enzyme/domain fusion proteins to specific genomic target sites will be apparent to those of skill in the art based on the instant disclosure. Such suitable guide RNA sequences typically comprise guide sequences that are complementary to a nucleic sequence within 50 nucleotides upstream or downstream of the target nucleotide to be edited. Some exemplary guide RNA sequences suitable for targeting any of the provided fusion proteins to specific target sequences are provided herein.

Base Editor Efficiency

The fusion proteins of the invention improve base editor efficiency by modifying a specific nucleotide base without generating a significant proportion of indels. An "indel", as used herein, refers to the insertion or deletion of a nucleotide base within a nucleic acid. Such insertions or deletions can lead to frame shift mutations within a coding region of a gene. In some embodiments, it is desirable to generate base editors that efficiently modify (e.g. mutate) a specific nucleotide within a nucleic acid, without generating a large number of insertions or deletions (i.e., indels) in the nucleic acid. In certain embodiments, any of the base editors provided herein are capable of generating a greater proportion of intended modifications (e.g., mutations) versus indels. In some embodiments, the base editors provided herein are capable of generating a ratio of intended mutation to indels that is greater than 1:1. In some embodiments, the base editors provided herein are capable of generating a ratio of intended mutations to indels that is at least 1.5:1, at least 2:1, at least 2.5:1, at least 3:1, at least 3.5:1, at least 4:1, at least 4.5:1, at least 5:1, at least 5.5:1, at least 6:1, at least 6.5:1, at least 7:1, at least 7.5:1, at least 8:1, at least 10:1, at least 12:1, at least 15:1, at least 20:1, at least 25:1, at least 30:1, at least 40:1, at least 50:1, at least 100:1, at least 200:1, at least 300:1, at least 400:1, at least 500:1, at least 600:1, at least 700:1, at least 800:1, at least 900:1, or at least 1000:1, or more. The number of intended mutations and indels may be determined using any suitable method.

In some embodiments, the base editors provided herein are capable of limiting formation of indels in a region of a nucleic acid. In some embodiments, the region is at a nucleotide targeted by a base editor or a region within 2, 3, 4, 5, 6, 7, 8, 9, or 10 nucleotides of a nucleotide targeted by a base editor. In some embodiments, any of the base editors provided herein are capable of limiting the formation of indels at a region of a nucleic acid to less than 1%, less than 1.5%, less than 2%, less than 2.5%, less than 3%, less than 3.5%, less than 4%, less than 4.5%, less than 5%, less than 6%, less than 7%, less than 8%, less than 9%, less than 10%, less than 12%, less than 15%, or less than 20%. The number of indels formed at a nucleic acid region may depend on the amount of time a nucleic acid (e.g., a nucleic acid within the genome of a cell) is exposed to a base editor. In some embodiments, an number or proportion of indels is determined after at least 1 hour, at least 2 hours, at least 6 hours, at least 12 hours, at least 24 hours, at least 36 hours, at least 48 hours, at least 3 days, at least 4 days, at least 5 days, at least 7 days, at least 10 days, or at least 14 days of exposing a nucleic acid (e.g., a nucleic acid within the genome of a cell) to a base editor.

Some aspects of the disclosure are based on the recognition that any of the base editors provided herein are capable of efficiently generating an intended mutation in a nucleic acid (e.g. a nucleic acid within a genome of a subject) without generating a significant number of unintended mutations. In some embodiments, an intended mutation is a mutation that is generated by a specific base editor bound to a gRNA, specifically designed to generate the intended mutation. In some embodiments, the intended mutation is a mutation that generates a stop codon, for example, a premature stop codon within the coding region of a gene. In some embodiments, the intended mutation is a mutation that eliminates a stop codon. In some embodiments, the intended mutation is a mutation that alters the splicing of a gene. In some embodiments, the intended mutation is a mutation that alters the regulatory sequence of a gene (e.g., a gene promotor or gene repressor). In some embodiments, any of the base editors provided herein are capable of generating a ratio of intended mutations to unintended mutations (e.g., intended mutations: unintended mutations) that is greater than 1:1.

In some embodiments, any of the base editors provided herein are capable of generating a ratio of intended mutations to unintended mutations that is at least 1.5:1, at least 2:1, at least 2.5:1, at least 3:1, at least 3.5:1, at least 4:1, at least 4.5:1, at least 5:1, at least 5.5:1, at least 6:1, at least 6.5:1, at least 7:1, at least 7.5:1, at least 8:1, at least 10:1, at least 12:1, at least 15:1, at least 20:1, at least 25:1, at least 30:1, at least 40:1, at least 50:1, at least 100:1, at least 150:1, at least 200:1, at least 250:1, at least 500:1, or at least 1000:1, or more. It should be appreciated that the characteristics of the base editors described in the "Base Editor Efficiency" section, herein, may be applied to any of the fusion proteins, or methods of using the fusion proteins provided herein.

Methods for Editing Nucleic Acids

Some aspects of the disclosure provide methods for editing a nucleic acid. In some embodiments, the method is a method for editing a nucleobase of a nucleic acid (e.g., a base pair of a double-stranded DNA sequence). In some embodiments, the method comprises the steps of: a) contacting a target region of a nucleic acid (e.g., a double-stranded DNA sequence) with a complex comprising a base editor and a guide nucleic acid (e.g., gRNA), b) inducing strand separation of said target region, c) converting a first nucleobase of said target nucleobase pair in a single strand of the target region to a second nucleobase, and d) cutting no more than one strand of said target region using the nCas9, where a third nucleobase complementary to the first nucleobase base is replaced by a fourth nucleobase complementary to the second nucleobase. In some embodiments, the method results in less than 20% indel formation in the nucleic acid. It should be appreciated that in some embodiments, step b is omitted. In some embodiments, the method results in less than 19%, 18%, 16%, 14%, 12%, 10%, 8%, 6%, 4%, 2%, 1%, 0.5%, 0.2%, or less than 0.1% indel formation. In some embodiments, the method further comprises replacing the second nucleobase with a fifth nucleobase that is complementary to the fourth nucleobase, thereby generating an intended edited base pair (e.g., G·C to A·T). In some embodiments, at least 5% of the intended base pairs are edited. In some embodiments, at least 10%, 15%, 20%, 25%, 30%, 35%, 40%, 45%, or 50% of the intended base pairs are edited.

In some embodiments, the ratio of intended products to unintended products in the target nucleotide is at least 2:1, 5:1, 10:1, 20:1, 30:1, 40:1, 50:1, 60:1, 70:1, 80:1, 90:1, 100:1, or 200:1, or more. In some embodiments, the ratio of intended mutation to indel formation is greater than 1:1, 10:1, 50:1, 100:1, 500:1, or 1000:1, or more. In some embodiments, the cut single strand (nicked strand) is hybridized to the guide nucleic acid. In some embodiments, the cut single strand is opposite to the strand comprising the first nucleobase. In some embodiments, the base editor comprises a dCas9 domain. In some embodiments, the base editor protects or binds the non-edited strand. In some embodiments, the intended edited base pair is upstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edited base pair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream stream of the PAM site. In some embodiments, the method does not require a canonical (e.g., NGG) PAM site. In some embodiments, the nucleobase editor comprises a linker. In some embodiments, the linker is 1-25 amino acids in length. In some embodiments, the linker is 5-20 amino acids in length. In some embodiments, linker is 10, 11, 12, 13, 14, 15, 16, 17, 18, 19, or 20 amino acids in length. In one embodiment, the linker is 32 amino acids in length. In another embodiment, a "long linker" is at least about 60 amino acids in length. In other embodiments, the linker is between about 3-100 amino acids in length. In some embodiments, the target region comprises a target window, wherein the target window comprises the target nucleobase pair. In some embodiments, the target window comprises 1-10 nucleotides. In some embodiments, the target window is 1-9, 1-8, 1-7, 1-6, 1-5, 1-4, 1-3, 1-2, or 1 nucleotides in length. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edited base pair is within the target window. In some embodiments, the target window comprises the intended edited base pair. In some embodiments, the method is performed using any of the base editors provided herein.

In some embodiments, the disclosure provides methods for editing a nucleotide. In some embodiments, the disclosure provides a method for editing a nucleobase pair of a double-stranded DNA sequence. In some embodiments, the method comprises a) contacting a target region of the double-stranded DNA sequence with a complex comprising a base editor and a guide nucleic acid (e.g., gRNA), where the target region comprises a target nucleobase pair, b) inducing strand separation of said target region, c) converting a first nucleobase of said target nucleobase pair in a single strand of the target region to a second nucleobase, d) cutting no more than one strand of said target region, wherein a third nucleobase complementary to the first nucleobase base is replaced by a fourth nucleobase complementary to the second nucleobase, and the second nucleobase is replaced with a fifth nucleobase that is complementary to the fourth nucleobase, thereby generating an intended edited base pair, wherein the efficiency of generating the intended edited base pair is at least 5%. It should be appreciated that in some embodiments, step b is omitted. In some embodiments, at least 5% of the intended base pairs are edited. In some embodiments, at least 10%, 15%, 20%, 25%, 30%, 35%, 40%, 45%, or 50% of the intended base pairs are edited. In some embodiments, the method causes less than 19%, 18%, 16%, 14%, 12%, 10%, 8%, 6%, 4%, 2%, 1%, 0.5%, 0.2%, or less than 0.1% indel formation. In some embodiments, the ratio of intended product to unintended products at the target nucleotide is at least 2:1, 5:1, 10:1, 20:1, 30:1, 40:1, 50:1, 60:1, 70:1, 80:1, 90:1, 100:1, or 200:1, or more. In some embodiments, the ratio of intended mutation to indel formation is greater than 1:1, 10:1, 50:1, 100:1, 500:1, or 1000:1, or more. In some embodiments, the cut single strand is hybridized to the guide nucleic acid. In some embodiments, the cut single strand is opposite to the strand comprising the first nucleobase. In some embodiments, the intended edited base pair is upstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edited base pair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream stream of the PAM site. In some embodiments, the method does not require a canonical (e.g., NGG) PAM site. In some embodiments, the linker is 1-25 amino acids in length. In some embodiments, the linker is 5-20 amino acids in length. In some embodiments, the linker is 10, 11, 12, 13, 14, 15, 16, 17, 18, 19, or 20 amino acids in length. In some embodiments, the target region comprises a target window, wherein the target window comprises the target nucleobase pair. In some embodiments, the target window comprises 1-10 nucleotides. In some embodiments, the target window is 1-9, 1-8, 1-7, 1-6, 1-5, 1-4, 1-3, 1-2, or 1 nucleotides in length. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edited base pair occurs within the target window. In some embodiments, the target window comprises the intended edited base pair. In some embodiments, the nucleobase editor is any one of the base editors provided herein.

Expression of Fusion Proteins in a Host Cell

Fusion proteins of the invention may be expressed in virtually any host cell of interest, including but not limited to bacteria, yeast, fungi, insects, plants, and animal cells using routine methods known to the skilled artisan. Fusion proteins are generated by operably linking one or more polynucleotides encoding one or more domains having nucleobase modifying activity (e.g., an adenosine deaminase or cytidine deaminase) to a polynucleotide encoding a napDNAbp to prepare a polynucleotide that encodes a fusion protein of the invention A DNA encoding a protein domain described herein can be obtained by any method known in the art, such as by chemically synthesizing the DNA chain, by PCR, or by the Gibson Assembly method. The advantage of constructing a full-length DNA by chemical synthesis or a combination of PCR method or Gibson Assembly method is that the codons may be optimized to ensure that the fusion protein is expressed at a high level in a host cell.

Optimized codons may be selected using the genetic code use frequency database (kazusa.or.jp/codon/index.html), which is disclosed in the home page of Kazusa DNA Research Institute. Once obtained polynucleotides encoding fusion proteins are incorporated into suitable expression vectors.

Suitable expression vectors include *Escherichia coli*-derived plasmids (e.g., pBR322, pBR325, pUC12, pUC13); *Bacillus subtilis*-derived plasmids (e.g., pUB110, pTP5, pC194); yeast-derived plasmids (e.g., pSH19, pSH15); plasmids suitable for expression in insect cells (e.g., pFast-Bac); plasmids suitable for expression in mammalian cells (e.g., pA1-11, pXT1, pRc/CMV, pRc/RSV, pcDNAI/Neo); also bacteriophages, such as lamda phage and the like; other vectors that may be used include insect viral vectors, such as baculovirus and the like (e.g., BmNPV, AcNPV); and viral vectors suitable for expression in a mammalian cell, such as retrovirus, vaccinia virus, adenovirus and the like.

Fusion protein encoding polynucleotides are typically expressed under the control of a suitable promoter that is useful for expression in a desired host cell. For example, when the host is an animal cell, any one of the following promoters are used SR alpha promoter, SV40 promoter, LTR promoter, CMV (cytomegalovirus) promoter, RSV (Rous sarcoma virus) promoter, MoMuLV (Moloney mouse leukemia virus) LTR, HSV-TK (simple herpes virus thymidine kinase) promoter and the like are used. In one embodiment, the promoter is CMV promoter or SR alpha promoter. When the host cell is *Escherichia coli*, any of the following promoters may be used: trp promoter, lac promoter, recA promoter, lamda.P.sub.L promoter, lpp promoter, T7 promoter and the like. When the host is genus *Bacillus*, any of the following promoters may be used: SPO1 promoter, SPO2 promoter, penP promoter and the like. When the host is a yeast, any of the following promoters may be used: Gal1/10 promoter, PHO5 promoter, PGK promoter, GAP promoter, ADH promoter and the like. When the host is an insect cell, any of the following promoters may be used polyhedrin promoter, P10 promoter and the like. When the host is a plant cell, any of the following promoters may be used: CaMV35S promoter, CaMV19S promoter, NOS promoter and the like.

If desired, the expression vector also includes any one or more of an enhancer, splicing signal, terminator, polyA addition signal, a selection marker (e.g., a drug resistance gene, auxotrophic complementary gene and the like), or a replication origin.

An RNA encoding a protein domain described herein can be prepared by, for example, by transcribing an mRNA in an in vitro transcription system.

A fusion protein of the invention can be expressed by introducing an expression vector encoding a fusion protein into a host cell, and culturing the host cell. Host cells useful in the invention include bacterial cells, yeast, insect cells, mammalian cells and the like.

The genus *Escherichia* includes *Escherichia coli* K12.cndot.DH1 [Proc. Natl. Acad.USA, 60, 160 (1968)], *Escherichia coli* JM103 [Nucleic Acids Research, 9, 309 (1981)], *Escherichia coli* JA221 [Journal of Molecular Biology, 120, 517 (1978)], *Escherichia coli* HB101 [Journal of Molecular Biology, 41, 459 (1969)], *Escherichia coli* C600 [Genetics, 39, 440 (1954)] and the like.

The genus *Bacillus* includes *Bacillus subtilis* M1114 [Gene, 24, 255 (1983)], *Bacillus subtilis* 207-21 [Journal of Biochemistry, 95, 87 (1984)] and the like.

Yeast useful for expressing fusion proteins of the invention include *Saccharomyces cerevisiae* AH22, AH22R.sup.-, NA87-11A, DKD-5D, 20B-12, *Schizosaccharomyces pombe* NCYC1913, NCYC2036, *Pichia pastoris* KM71 and the like are used.

Fusion proteins are expressed in insect cells using, for example, viral vectors, such as AcNPV. Insect host cells include any of the following cell lines: cabbage armyworm larva-derived established line (*Spodoptera frugiperda* cell; Sf cell), MG1 cells derived from the mid-intestine of Trichoplusiani, High Five, cells derived from an egg of Trichoplusiani, *Mamestra brassicae*-derived cells, Estigmena acrea-derived cells and the like are used. When the virus is BmNPV, cells of a *Bombyx mori*-derived line (*Bombyx mori* N cell; BmN cell) and the like are used. Sf cells include, for example, Sf9 cell (ATCC CRL1711), Sf21 cell [all above, In Vivo, 13, 213-217 (1977)] and the like.

With regard to insects, larva of *Bombyx mori*, *Drosophila*, cricket and the like are used to express fusion proteins [Nature, 315, 592 (1985)].

Mammalian cell lines may be used to express fusion proteins. Such cell lines include monkey COS-7 cell, monkey Vero cell, Chinese hamster ovary (CHO) cell, dhfr gene-deficient CHO cell, mouse L cell, mouse AtT-20 cell, mouse myeloma cell, rat GH3 cell, human FL cell and the like. Pluripotent stem cells, such as iPS cell, ES cell and the like of human and other mammals, and primary cultured cells prepared from various tissues are used. Furthermore, zebrafish embryo, *Xenopus* oocyte and the like can also be used.

Plant cells may be maintained in culture using methods well known to the skilled artisan. Plant cell culture involves suspending cultured cells, callus, protoplast, leaf segment, root segment and the like, which are prepared from various plants (e.g., s rice, wheat, corn, tomato, cucumber, eggplant, carnations, *Eustoma* russellianum, tobacco, *Arabidopsis thaliana* a.

All the above-mentioned host cells may be haploid (monoploid), or polyploid (e.g., diploid, triploid, tetraploid and the like.

Expression vectors encoding a fusion protein of the invention are introduced into host cells using any transfection method (e.g., using lysozyme, PEG, CaCl2 coprecipitation, electroporation, microinjection, particle gun, lipofection, *Agrobacterium* and the like). The transfection method is selected based on the host cell to be transfected. *Escherichia coli* can be transformed according to the methods described in, for example, Proc. Natl. Acad. Sci. USA, 69, 2110 (1972), Gene, 17, 107 (1982) and the like. Methods for transducing the genus *Bacillus* are described in, for example, Molecular & General Genetics, 168, 111 (1979). Yeast cells are transduced using methods described in, for example, Methods in Enzymology, 194, 182-187 (1991), Proc. Natl. Acad. Sci. USA, 75, 1929 (1978) and the like. Insect cells are transfected using methods described in, for example, Bio/Technology, 6, 47-55 (1988) and the like.

Mammalian cells are transfected using methods described in, for example, Cell Engineering additional volume 8, New Cell Engineering Experiment Protocol, 263-267 (1995) (published by Shujunsha), and Virology, 52, 456 (1973).

Cells comprising expression vectors of the invention are cultured according to known methods, which vary depending on the host.

For example, when *Escherichia coli* or genus *Bacillus* cells are cultured, a liquid medium is used. The medium preferably contains a carbon source, nitrogen source, inorganic substance and other components necessary for the growth of the transformant. Examples of the carbon source include glucose, dextrin, soluble starch, sucrose and the like; examples of the nitrogen source include inorganic or organic substances such as ammonium salts, nitrate salts, corn steep liquor, peptone, casein, meat extract, soybean cake, potato extract and the like; and examples of the inorganic substance include calcium chloride, sodium dihydrogen phosphate, magnesium chloride and the like. The medium may also contain yeast extract, vitamins, growth promoting factors and the like. The pH of the medium is preferably between about 5 to about 8.

As a medium for culturing *Escherichia coli*, for example, M9 medium containing glucose, casamino acid [Journal of Experiments in Molecular Genetics, 431-433, Cold Spring Harbor Laboratory, New York 1972] is used. *Escherichia coli* is cultured at generally about 15-about 43° C. Where necessary, aeration and stirring may be performed.

The genus *Bacillus* is cultured at generally about 30 to about 40° C. Where necessary, aeration and stirring is performed.

Examples of medium suitable for culturing yeast include Burkholder minimum medium [Proc. Natl. Acad. Sci. USA, 77, 4505 (1980)], SD medium containing 0.5% casamino acid [Proc. Natl. Acad. Sci. USA, 81, 5330 (1984)] and the like. The pH of the medium is preferably about 5-about 8. The culture is performed at generally about 20° C. to about 35° C. Where necessary, aeration and stirring may be performed.

As a medium for culturing an insect cell or insect, Grace's Insect Medium [Nature, 195, 788 (1962)] containing an additive such as inactivated 10% bovine serum and the like are used. The pH of the medium is preferably about 6.2 to about 6.4. Cells are cultured at about 27° C. Where necessary, aeration and stirring may be performed.

Mammalian cells are cultured, for example, in any one of minimum essential medium (MEM) containing about 5 to about 20% of fetal bovine serum [Science, 122, 501 (1952)], Dulbecco's modified Eagle medium (DMEM) [Virology, 8, 396 (1959)], RPMI 1640 medium [The Journal of the American Medical Association, 199, 519 (1967)], 199 medium [Proceeding of the Society for the Biological Medicine, 73, 1 (1950)] and the like. The pH of the medium is preferably about 6 to about 8. The culture is performed at about 30° C. to about 40° C. Where necessary, aeration and stirring may be performed.

As a medium for culturing a plant cell, for example, MS medium, LS medium, B5 medium and the like are used. The pH of the medium is preferably about 5 to about 8. The culture is performed at generally about 20° C. to about 30° C. Where necessary, aeration and stirring may be performed.

Fusion protein expression may be regulated using an inducible promoter (e.g., metallothionein promoter (induced by heavy metal ion), heat shock protein promoter (induced by heat shock), Tet-ON/Tet-OFF system promoter (induced by addition or removal of tetracycline or a derivative thereof), steroid-responsive promoter (induced by steroid hormone or a derivative thereof) etc.), the inducing agent is added to the medium (or removed from the medium) at an appropriate stage to induce expression of the fusion protein.

Prokaryotic cells such as *Escherichia coli* and the like can utilize an inductive promoter. Examples of the inducible promoters include, but are not limited to, lac promoter (induced by IPTG), cspA promoter (induced by cold shock), araBAD promoter (induced by arabinose) and the like.

Nucleic Acid-Based Delivery of a Nucleobase Editor

Nucleic acids encoding nucleobase editors according to the present disclosure can be administered to subjects or delivered into cells (e.g., bacteria, yeast, fungi, insects, plants, and animal cells) by art-known methods or as described herein. For example, nucleobase editors can be delivered by, e.g., vectors (e.g., viral or non-viral vectors), non-vector based methods (e.g., using naked DNA or DNA complexes), or a combination thereof.

Nucleic acids encoding nucleobase editors can be delivered directly to cells (e.g., bacteria, yeast, fungi, insects, plants, and animal cells) as naked DNA or RNA, for instance by means of transfection or electroporation, or can be conjugated to molecules (e.g., N-acetylgalactosamine) promoting uptake by the target cells. Nucleic acid vectors, such as the vectors can also be used.

Nucleic acid vectors can comprise one or more sequences encoding a domain of a fusion protein described herein. A vector can also comprise a sequence encoding a signal peptide (e.g., for nuclear localization, nucleolar localization, or mitochondrial localization), associated with (e.g., inserted into or fused to) a sequence coding for a protein. As one example, a nucleic acid vectors can include a Cas9 coding sequence that includes one or more nuclear localization sequences (e.g., a nuclear localization sequence from SV40), and one or more deaminases.

The nucleic acid vector can also include any suitable number of regulatory/control elements, e.g., promoters, enhancers, introns, polyadenylation signals, Kozak consensus sequences, or internal ribosome entry sites (IRES). These elements are well known in the art. Nucleic acid vectors according to this disclosure include recombinant viral vectors. Exemplary viral vectors are set forth herein above. Other viral vectors known in the art can also be used. In addition, viral particles can be used to deliver genome editing system components in nucleic acid and/or peptide form. For example, "empty" viral particles can be assembled to contain any suitable cargo. Viral vectors and viral particles can also be engineered to incorporate targeting ligands to alter target tissue specificity.

In addition to viral vectors, non-viral vectors can be used to deliver nucleic acids encoding genome editing systems according to the present disclosure. One important category of non-viral nucleic acid vectors are nanoparticles, which can be organic or inorganic. Nanoparticles are well known in the art. Any suitable nanoparticle design can be used to deliver genome editing system components or nucleic acids encoding such components. For instance, organic (e.g. lipid and/or polymer) nanoparticles can be suitable for use as delivery vehicles in certain embodiments of this disclosure. Exemplary lipids for use in nanoparticle formulations, and/or gene transfer are shown in Table 6 (below).

TABLE 6

Lipids Used for Gene Transfer

| Lipid | Abbreviation | Feature |
|---|---|---|
| 1,2-Dioleoyl-sn-glycero-3-phosphatidylcholine | DOPC | Helper |
| 1,2-Dioleoyl-sn-glycero-3-phosphatidylethanolamine | DOPE | Helper |
| Cholesterol | | Helper |
| N-[1-(2,3-Dioleyloxy)prophyl]N,N,N-trimethylammonium chloride | DOTMA | Cationic |
| 1,2-Dioleoyloxy-3-trimethylammonium-propane | DOTAP | Cationic |
| Dioctadecylamidoglycylspermine | DOGS | Cationic |
| N-(3-Aminopropyl)-N,N-dimethyl-2,3-bis(dodecyloxy)-1-propanaminium bromide | GAP-DLRIE | Cationic |
| Cetyltrimethylammonium bromide | CTAB | Cationic |
| 6-Lauroxyhexyl ornithinate | LHON | Cationic |
| 1-(2,3-Dioleoyloxypropyl)-2,4,6-trimethylpyridinium | 2Oc | Cationic |
| 2,3-Dioleyloxy-N-[2(sperminecarboxamido-ethyl]-N,N-dimethyl-1-propanaminium trifluoroacetate | DOSPA | Cationic |
| 1,2-Dioleyl-3-trimethylammonium-propane | DOPA | Cationic |
| N-(2-Hydroxyethyl)-N,N-dimethyl-2,3-bis(tetradecyloxy)-1-propanaminium bromide | MDRIE | Cationic |
| Dimyristooxypropyl dimethyl hydroxyethyl ammonium bromide | DMRI | Cationic |
| 3B-[N-(N',N'-Dimethylaminoethane)-carbamoyl]cholesterol | DC-Chol | Cationic |
| Bis-guanidium-tren-cholesterol | BGTC | Cationic |
| 1,3-Diodeoxy-2-(6-carboxy-spermyl)-propylamide | DOSPER | Cationic |
| Dimethyloctadecylammonium bromide | DDAB | Cationic |
| Dioctadecylamidoglicylspermidin | DSL | Cationic |
| rac-[(2,3-Dioctadecyloxypropyl)(2-hydroxyethyl)]-dimethylammonium chloride | CLIP-1 | Cationic |
| rac-[2(2,3-Dihexadecyloxypropyl-oxymethyloxy)ethyl]trimethylammoniun bromide | CLIP-6 | Cationic |

TABLE 6-continued

Lipids Used for Gene Transfer

| Lipid | Abbreviation | Feature |
|---|---|---|
| Ethyldimyristoylphosphatidylcholine | EDMPC | Cationic |
| 1,2-Distearyloxy-N,N-dimethyl-3-aminopropane | DSDMA | Cationic |
| 1,2-Dimyristoyl-trimethylammonium propane | DMTAP | Cationic |
| O,O'-Dimyristyl-N-lysyl aspartate | DMKE | Cationic |
| 1,2-Distearoyl-sn-glycero-3-ethylpho sphocholine | DSEPC | Cationic |
| N-Palmitoyl D-erythro-sphingosyl carbamoyl-spermine | CCS | Cationic |
| N-t-Butyl-NO-tetradecyl-3-tetradecylaminopropionamidine | diC14-amidine | Cationic |
| Octadecenolyoxy[ethyl-2-heptadecenyl-3 hydroxyethyl] imidazolinium chloride | DOTIM | Cationic |
| N1-Cholesteryloxycarbonyl-3,7-diazanonane-1,9-diamine | CDAN | Cationic |
| 2-(3-[Bis(3-amino-propyl)-amino]propylamino)-N-ditetradecylcarbamoylme-ethyl-acetamide | RPR209120 | Cationic |
| 1,2-dilinoleyloxy-3-dimethylaminopropane | DLinDMA | Cationic |
| 2,2-dilinoleyl-4-dimethylaminoethyl-[1,3]-dioxolane | DLin-KC2-DMA | Cationic |
| dilinoleyl-methyl-4-dimethylaminobutyrate | DLin-MC3-DMA | Cationic |

Table 7 lists exemplary polymers for use in gene transfer and/or nanoparticle formulations.

TABLE 7

Polymers Used for Gene Transfer

| Polymer | Abbreviation |
|---|---|
| Poly(ethylene)glycol | PEG |
| Polyethylenimine | PEI |
| Dithiobis (succinimidylpropionate) | DSP |
| Dimethyl-3,3'-dithiobispropionimidate | DTBP |
| Poly(ethylene imine)biscarbamate | PEIC |
| Poly(L-lysine) | PLL |
| Histidine modified PLL | |
| Poly(N-vinylpyrrolidone) | PVP |
| Poly (propylenimine) | PPI |
| Poly(amidoamine) | PAMAM |
| Poly(amidoethylenimine) | SS-PAEI |
| Triethylenetetramine | TETA |
| Poly(β-aminoester) | |
| Poly(4-hydroxy-L-proline ester) | PHP |
| Poly(allylamine) | |
| Poly(α-[4-aminobutyl]-L-glycolic acid) | PAGA |
| Poly(D,L-lactic-co-glycolic acid) | PLGA |
| Poly(N-ethyl-4-vinylpyridinium bromide) | |
| Poly (phosphazene)s | PPZ |
| Poly (phosphoester)s | PPE |
| Poly (phosphoramidate)s | PPA |
| Poly(N-2-hydroxypropylmethacrylamide) | pHPMA |
| Poly (2-(dimethylamino)ethyl methacrylate) | pDMAEMA |
| Poly(2-aminoethyl propylene phosphate) | PPE-EA |
| Chitosan | |
| Galactosylated chitosan | |
| N-Dodacylated chitosan | |
| Histone | |
| Collagen | |
| Dextran-spermine | D-SPM |

Table 8 summarizes delivery methods for a polynucleotide encoding a fusion protein described herein.

TABLE 8

| Delivery | Vector/Mode | Delivery into Non-Dividing Cells | Duration of Expression | Genome Integration | Type of Molecule Delivered |
|---|---|---|---|---|---|
| Physical | (e.g., electroporation, particle gun, Calcium Phosphate transfection) | YES | Transient | NO | Nucleic Acids and Proteins |
| Viral | Retrovirus | NC | Stable | YES | RNA |
| | Lentivirus | YES | Stable | YES/NO with modification | RNA |
| | Adenovirus | YES | Transient | NO | DNA |
| | Adeno-Associated Virus (AAV) | YES | Stable | NO | DNA |
| | Vaccinia Virus | YES | Very Transient | NO | DNA |
| | Herpes Simplex Virus | YES | Stable | NO | DNA |
| Non-Viral | Cationic Liposomes | YES | Transient | Depends on what is delivered | Nucleic Acids and Proteins |
| | Polymeric Nanoparticles | YES | Transient | Depends on what is delivered | Nucleic Acids and Proteins |

TABLE 8-continued

| Delivery | Vector/Mode | Delivery into Non-Dividing Cells | Duration of Expression | Genome Integration | Type of Molecule Delivered |
|---|---|---|---|---|---|
| Biological Non-Viral Delivery Vehicles | Attenuated Bacteria | YES | Transient | NO | Nucleic Acids |
| | Engineered Bacteriophages | YES | Transient | NO | Nucleic Acids |
| | Mammalian Virus-like Particles | YES | Transient | NO | Nucleic Acids |
| | Biological liposomes: Erythrocyte Ghosts and Exosomes | YES | Transient | NO | Nucleic Acids |

In some aspects, the disclosure relates to the viral delivery of a fusion protein using, for example, a viral vector. Exemplary viral vectors include retroviral vectors (e.g. Maloney murine leukemia virus, MML-V), adenoviral vectors (e.g. AD100), lentiviral vectors (HIV and FIV-based vectors), herpesvirus vectors (e.g. HSV-2), and adeno-associated viral vectors.

Adeno-Associated Viral Vectors

AAV is a small, single-stranded DNA dependent virus belonging to the parvovirus family. The 4.7 kb wild-type (wt) AAV genome is made up of two genes that encode four replication proteins and three capsid proteins, respectively, and is flanked on either side by 145-bp inverted terminal repeats (ITRs). The virion is composed of three capsid proteins, Vp1, Vp2, and Vp3, produced in a 1:1:10 ratio from the same open reading frame but from differential splicing (Vp1) and alternative translational start sites (Vp2 and Vp3, respectively). Vp3 is the most abundant subunit in the virion and participates in receptor recognition at the cell surface defining the tropism of the virus. A phospholipase domain, which functions in viral infectivity, has been identified in the unique N terminus of Vp1. Similar to wt AAV, recombinant AAV (rAAV) utilizes the cis-acting 145-bp ITRs to flank vector transgene cassettes, providing up to 4.5 kb for packaging of foreign DNA. Subsequent to infection, rAAV can express a fusion protein of the invention and persist without integration into the host genome by existing episomally in circular head-to-tail concatemers. Although there are numerous examples of rAAV success using this system, in vitro and in vivo, the limited packaging capacity has limited the use of AAV-mediated gene delivery when the length of the coding sequence of the gene is equal or greater in size than the wt AAV genome.

The small packaging capacity of AAV vectors makes the delivery of a number of genes that exceed this size and/or the use of large physiological regulatory elements challenging. These challenges can be addressed, for example, by dividing the protein(s) to be delivered into two or more fragments, wherein the N-terminal fragment is fused to a split intein-N and the C-terminal fragment is fused to a split intein-C. These fragments are then packaged into two or more AAV vectors. In one embodiment, inteins are utilized to join fragments or portions of a nucleobase editor protein that is grafted onto an AAV capsid protein. As used herein, "intein" refers to a self-splicing protein intron (e.g., peptide) that ligates flanking N-terminal and C-terminal exteins (e.g., fragments to be joined). The use of certain inteins for joining heterologous protein fragments is described, for example, in Wood et al., J. Biol. Chem. 289 (21); 14512-9 (2014). For example, when fused to separate protein fragments, the inteins IntN and IntC recognize each other, splice themselves out and simultaneously ligate the flanking N- and C-terminal exteins of the protein fragments to which they were fused, thereby reconstituting a full length protein from the two protein fragments. Other suitable inteins will be apparent to a person of skill in the art.

A fragment of a fusion protein of the invention can vary in length. In some embodiments, a protein fragment ranges from 2 amino acids to about 1000 amino acids in length. In some embodiments, a protein fragment ranges from about 5 amino acids to about 500 amino acids in length. In some embodiments, a protein fragment ranges from about 20 amino acids to about 200 amino acids in length. In some embodiments, a protein fragment ranges from about 10 amino acids to about 100 amino acids in length. Suitable protein fragments of other lengths will be apparent to a person of skill in the art.

In some embodiments, a portion or fragment of a nuclease (e.g., a fragment of a deaminase, such as cytidine deaminase, adenosine deaminase, or a fragment of Cas9) is fused to an intein. The nuclease can be fused to the N-terminus or the C-terminus of the intein. In some embodiments, a portion or fragment of a fusion protein is fused to an intein and fused to an AAV capsid protein. The intein, nuclease and capsid protein can be fused together in any arrangement (e.g., nuclease-intein-capsid, intein-nuclease-capsid, capsid-intein-nuclease, etc.). In some embodiments, the N-terminus of an intein is fused to the C-terminus of a fusion protein and the C-terminus of the intein is fused to the N-terminus of an AAV capsid protein.

In one embodiment, dual AAV vectors are generated by splitting a large transgene expression cassette in two separate halves (5' and 3' ends, or head and tail), where each half of the cassette is packaged in a single AAV vector (of <5 kb). The re-assembly of the full-length transgene expression cassette is then achieved upon co-infection of the same cell by both dual AAV vectors followed by: (1) homologous recombination (HR) between 5' and 3' genomes (dual AAV overlapping vectors); (2) ITR-mediated tail-to-head concatemerization of 5' and 3' genomes (dual AAV trans-splicing vectors); or (3) a combination of these two mechanisms (dual AAV hybrid vectors). The use of dual AAV vectors in vivo results in the expression of full-length proteins. The use of the dual AAV vector platform represents an efficient and viable gene transfer strategy for transgenes of >4.7 kb in size.

Screening of Nucleobase Editors

The suitability of nucleobase editors fusion proteins comprising "split" and reassembled Cas9 can be evaluated in various screening approaches as described herein. Each fragment of the fusion protein to be tested is delivered to a single cell of interest (e.g., a bacteria, yeast, fungi, insect, plant, or animal cell) together with a small amount of a vector encoding a reporter (e.g., GFP). These cells can be immortalized in human cell lines such as 293T, K562 or U20S. Alternatively, primary human cells may be used. Such cells may be relevant to the eventual cell target.

Delivery may be performed using a viral vector. In one embodiment, transfection may be performed using lipid transfection (such as Lipofectamine or Fugene) or by electroporation. Following transfection, expression of GFP can be determined either by fluorescence microscopy or by flow cytometry to confirm consistent and high levels of transfection. These preliminary transfections can comprise different nucleobase editors to determine which combinations of editors give the greatest activity.

The activity of the nucleobase editor is assessed as described herein, i.e., by sequencing the genome of the cells to detect alterations in a target sequence. For Sanger sequencing, purified PCR amplicons are cloned into a plasmid backbone, transformed, miniprepped and sequenced with a single primer. Sequencing may also be performed using next generation sequencing techniques. When using next generation sequencing, amplicons may be 300-500 bp with the intended cut site placed asymmetrically. Following PCR, next generation sequencing adapters and barcodes (for example Illumina multiplex adapters and indexes) may be added to the ends of the amplicon, e.g., for use in high throughput sequencing (for example on an Illumina MiSeq).

The fusion proteins that induce the greatest levels of target specific alterations in initial tests can be selected for further evaluation.

In particular embodiments, the nucleobase editors are used to target polynucleotides of interest. In one embodiment, a nucleobase editor is used to target a regulatory sequence, including but not limited to splice sites, enhancers, and transcriptional regulatory elements.

The effect of the alteration on the expression of a gene controlled by the regulatory element is then assayed using any method known in the art.

In other embodiments, a nucleobase editor of the invention is used to target a polynucleotide encoding a Complementarity Determining Region (CDR), thereby creating alterations in the expressed CDR. The effect of these alterations on CDR function is then assayed, for example, by measuring the specific binding of the CDR to its antigen.

In still other embodiments, a nucleobase editor of the invention is used to target polynucleotides of interest within the genome of an organism (e.g., bacteria, yeast, fungi, insect, plant, and animal). In one embodiment, a nucleobase editor of the invention is delivered to cells in conjunction with a library of guide RNAs that are used to tile a variety of sequences within the genome of a cell, thereby systematically altering sequences throughout the genome.

Applications for Nucleobase Editors

The nucleobase editors can be used to target polynucleotides of interest to create alterations that modify protein expression. In one embodiment, a nucleobase editor is used to modify a non-coding or regulatory sequence, including but not limited to splice sites, enhancers, and transcriptional regulatory elements. The effect of the alteration on the expression of a gene controlled by the regulatory element is then assayed using any method known in the art. In a particular embodiment, a nucleobase editor is able to substantially alter a regulatory sequence, thereby abolishing its ability to regulate gene expression. Advantageously, this can be done without generating double-stranded breaks in the genomic target sequence, in contrast to other RNA-programmable nucleases.

The nucleobase editors can be used to target polynucleotides of interest to create alterations that modify protein activity. In the context of mutagenesis, for example, nucleobase editors have a number of advantages over error-prone PCR and other polymerase-based methods. Unlike error-prone PCR, which induces random alterations throughout a polynucleotide, nucleobase editors of the invention can be used to target specific amino acids within a defined region of a protein of interest.

In other embodiments, nucleobase editor of the invention is used to target a polynucleotide of interest within the genome of an organism. In one embodiment, the organism is a bacteria of the microbiome (e.g., Bacteriodetes, Verrucomicrobia, Firmicutes; Gammaproteobacteria, Alphaproteobacteria, Bacteriodetes, Clostridia, Erysipelotrichia, Bacilli; Enterobacteriales, Bacteroidales, Verrucomicrobiales, Clostridiales, Erysipelotrichales, Lactobacillusacteriaceae, Bacteroidaceae, Erysiopelotrichaceae, Prevotellaceae, Coriobacteriaceae, and Alcaligenaceae; *Escherichia, Bacteroides*, Alistipes, Akkermansia, *Clostridium, Lactobacillus*). In another embodiment, the organism is an agriculturally important animal (e.g., cow, sheep, goat, horse, chicken, turkey) or plant (e.g., soybean, wheat, corn, cotton, canola, rice, tobacco, apple, grape, peach, plum, cherry). In one embodiment, a nucleobase editor of the invention is delivered to cells in conjunction with a library of guide RNAs that are used to tile a variety of sequences within the genome of a cell, thereby systematically altering sequences throughout the genome.

Mutations may be made in any of a variety of proteins to facilitate structure function analysis or to alter the endogenous activity of the protein. Mutations may be made, for example, in an enzyme (e.g., kinase, phosphatase, carboxylase, phosphodiesterase) or in an enzyme substrate, in a receptor or in its ligand, and in an antibody and its antigen. In one embodiment, a nucleobase editor targets a nucleic acid molecule encoding the active site of the enzyme, the ligand binding site of a receptor, or a complementarity determining region (CDR) of an antibody. In the case of an enzyme, inducing mutations in the active site could increase, decrease, or abolish the enzyme's activity. The effect of mutations on the enzyme is characterized in an enzyme activity assay, including any of a number of assays known in the art and/or that would be apparent to the skilled artisan. In the case of a receptor, mutations made at the ligand binding site could increase, decrease or abolish the receptors affinity for its ligand. The effect of such mutations is assayed in a receptor/ligand binding assay, including any of a number of assays known in the art and/or that would be apparent to the skilled artisan. In the case of a CDR, mutations made within the CDR could increase, decrease or abolish binding to the antigen. Alternatively, mutations made within the CDR could alter the specificity of the antibody for the antigen. The effect of these alterations on CDR function is then assayed, for example, by measuring the specific binding of the CDR to its antigen or in any other type of immunoassay.

The present disclosure provides methods for the treatment of a subject diagnosed with diseases associated with or caused by gene mutations, including gene conversion, point mutations that affect splicing (e.g., alter a splice donor or acceptor site), abberrent or mis-folded proteins due to point mutations that can be corrected by a base editor system provided herein. For example, in some embodiments, a method is provided that comprises administering to a subject having such a disease, e.g., a disease caused by a gene conversion or other genetic mutation, an effective amount of a nucleobase editor (e.g., an adenosine deaminase base editor or a cytidine deaminase base editor, including one or more than one DNA binding protein domains) that edits the nucleoside base directly or indirectly associated with the mutation in the disease associatedgene. In a certain aspect, methods are provided for the treatment of additional diseases or disorders, e.g., diseases or disorders that are associated or caused by a point mutation that can be corrected or ameliorated by deaminase mediated gene editing. Some such diseases are described herein, and additional suitable diseases that can be treated with the strategies and fusion proteins provided herein will be apparent to those of skill in the art based on the instant disclosure.

Pharmaceutical Compositions

Other aspects of the present disclosure relate to pharmaceutical compositions comprising any of the base editors, fusion proteins, or the fusion protein-guide polynucleotide complexes described herein. The term "pharmaceutical composition", as used herein, refers to a composition formulated for pharmaceutical use. In some embodiments, the pharmaceutical composition further comprises a pharmaceutically acceptable carrier. In some embodiments, the pharmaceutical composition comprises additional agents (e.g., for specific delivery, increasing half-life, or other therapeutic compounds).

As used here, the term "pharmaceutically-acceptable carrier" means a pharmaceutically-acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the compound from one site (e.g., the delivery site) of the body, to another site (e.g., organ, tissue or portion of the body). A pharmaceutically acceptable carrier is "acceptable" in the sense of being compatible with the other ingredients of the formulation and not injurious to the tissue of the subject (e.g., physiologically compatible, sterile, physiologic pH, etc.).

Some nonlimiting examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, methylcellulose, ethyl cellulose, microcrystalline cellulose and cellulose acetate; (4) powdered tragacanth; (5) malt; (6) gelatin; (7) lubricating agents, such as magnesium stearate, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol (PEG); (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23) serum alcohols, such as ethanol; and (23) other non-toxic compatible substances employed in pharmaceutical formulations. Wetting agents, coloring agents, release agents, coating agents, sweetening agents, flavoring agents, perfuming agents, preservative and antioxidants can also be present in the formulation. The terms such as "excipient," "carrier," "pharmaceutically acceptable carrier," "vehicle," or the like are used interchangeably herein.

Pharmaceutical compositions can comprise one or more pH buffering compounds to maintain the pH of the formulation at a predetermined level that reflects physiological pH, such as in the range of about 5.0 to about 8.0. The pH buffering compound used in the aqueous liquid formulation can be an amino acid or mixture of amino acids, such as histidine or a mixture of amino acids such as histidine and glycine. Alternatively, the pH buffering compound is preferably an agent which maintains the pH of the formulation at a predetermined level, such as in the range of about 5.0 to about 8.0, and which does not chelate calcium ions. Illustrative examples of such pH buffering compounds include, but are not limited to, imidazole and acetate ions. The pH buffering compound may be present in any amount suitable to maintain the pH of the formulation at a predetermined level.

Pharmaceutical compositions can also contain one or more osmotic modulating agents, i.e., a compound that modulates the osmotic properties (e.g, tonicity, osmolality, and/or osmotic pressure) of the formulation to a level that is acceptable to the blood stream and blood cells of recipient individuals. The osmotic modulating agent can be an agent that does not chelate calcium ions. The osmotic modulating agent can be any compound known or available to those skilled in the art that modulates the osmotic properties of the formulation. One skilled in the art may empirically determine the suitability of a given osmotic modulating agent for use in the inventive formulation. Illustrative examples of suitable types of osmotic modulating agents include, but are not limited to: salts, such as sodium chloride and sodium acetate; sugars, such as sucrose, dextrose, and mannitol; amino acids, such as glycine; and mixtures of one or more of these agents and/or types of agents. The osmotic modulating agent(s) may be present in any concentration sufficient to modulate the osmotic properties of the formulation.

In some embodiments, the pharmaceutical composition is formulated for delivery to a subject, e.g., for gene editing. Suitable routes of administrating the pharmaceutical composition described herein include, without limitation: topical, subcutaneous, transdermal, intradermal, intralesional, intraarticular, intraperitoneal, intravesical, transmucosal, gingival, intradental, intracochlear, transtympanic, intraorgan, epidural, intrathecal, intramuscular, intravenous, intravascular, intraosseus, periocular, intratumoral, intracerebral, and intracerebroventricular administration.

In some embodiments, the pharmaceutical composition described herein is administered locally to a diseased site (e.g., tumor site). In some embodiments, the pharmaceutical composition described herein is administered to a subject by injection, by means of a catheter, by means of a suppository, or by means of an implant, the implant being of a porous, non-porous, or gelatinous material, including a membrane, such as a sialastic membrane, or a fiber.

In other embodiments, the pharmaceutical composition described herein is delivered in a controlled release system. In one embodiment, a pump can be used (See, e.g., Langer, 1990, Science 249:1527-1533; Sefton, 1989, CRC Crit. Ref. Biomed. Eng. 14:201; Buchwald et al., 1980, Surgery 88:507; Saudek et al., 1989, N. Engl. J. Med. 321:574). In another embodiment, polymeric materials can be used. (See, e.g., Medical Applications of Controlled Release (Langer and Wise eds., CRC Press, Boca Raton, Fla., 1974); Controlled Drug Bioavailability, Drug Product Design and Performance (Smolen and Ball eds., Wiley, New York, 1984); Ranger and Peppas, 1983, Macromol. Sci. Rev. Macromol.

Chem. 23:61. See also Levy et al., 1985, Science 228:190; During et al., 1989, Ann. Neurol. 25:351; Howard et ah, 1989, J. Neurosurg. 71:105.) Other controlled release systems are discussed, for example, in Langer, supra.

In some embodiments, the pharmaceutical composition is formulated in accordance with routine procedures as a composition adapted for intravenous or subcutaneous administration to a subject, e.g., a human. In some embodiments, pharmaceutical composition for administration by injection are solutions in sterile isotonic use as solubilizing agent and a local anesthetic such as lignocaine to ease pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where the pharmaceutical is to be administered by infusion, it can be dispensed with an infusion bottle containing sterile pharmaceutical grade water or saline. Where the pharmaceutical composition is administered by injection, an ampoule of sterile water for injection or saline can be provided so that the ingredients can be mixed prior to administration.

A pharmaceutical composition for systemic administration can be a liquid, e.g., sterile saline, lactated Ringer's or Hank's solution. In addition, the pharmaceutical composition can be in solid forms and re-dissolved or suspended immediately prior to use. Lyophilized forms are also contemplated. The pharmaceutical composition can be contained within a lipid particle or vesicle, such as a liposome or microcrystal, which is also suitable for parenteral administration. The particles can be of any suitable structure, such as unilamellar or plurilamellar, so long as compositions are contained therein. Compounds can be entrapped in "stabilized plasmid-lipid particles" (SPLP) containing the fusogenic lipid dioleoylphosphatidylethanolamine (DOPE), low levels (5-10 mol %) of cationic lipid, and stabilized by a polyethyleneglycol (PEG) coating (Zhang Y. P. et ah, Gene Ther. 1999, 6:1438-47). Positively charged lipids such as N-[1-(2,3-dioleoyloxi) propyl]-N,N,N-trimethyl-amonium-methylsulfate, or "DOTAP," are particularly preferred for such particles and vesicles. The preparation of such lipid particles is well known. See, e.g., U.S. Pat. Nos. 4,880,635; 4,906,477; 4,911,928; 4,917,951; 4,920,016; and 4,921,757; each of which is incorporated herein by reference.

The pharmaceutical composition described herein can be administered or packaged as a unit dose, for example. The term "unit dose" when used in reference to a pharmaceutical composition of the present disclosure refers to physically discrete units suitable as unitary dosage for the subject, each unit containing a predetermined quantity of active material calculated to produce the desired therapeutic effect in association with the required diluent; i.e., carrier, or vehicle.

Further, the pharmaceutical composition can be provided as a pharmaceutical kit comprising (a) a container containing a compound of the invention in lyophilized form and (b) a second container containing a pharmaceutically acceptable diluent (e.g., sterile used for reconstitution or dilution of the lyophilized compound of the invention. Optionally associated with such container(s) can be a notice in the form prescribed by a governmental agency regulating the manufacture, use or sale of pharmaceuticals or biological products, which notice reflects approval by the agency of manufacture, use or sale for human administration.

In another aspect, an article of manufacture containing materials useful for the treatment of the diseases described above is included. In some embodiments, the article of manufacture comprises a container and a label. Suitable containers include, for example, bottles, vials, syringes, and test tubes. The containers can be formed from a variety of materials such as glass or plastic. In some embodiments, the container holds a composition that is effective for treating a disease described herein and can have a sterile access port. For example, the container can be an intravenous solution bag or a vial having a stopper pierceable by a hypodermic injection needle. The active agent in the composition is a compound of the invention. In some embodiments, the label on or associated with the container indicates that the composition is used for treating the disease of choice. The article of manufacture can further comprise a second container comprising a pharmaceutically-acceptable buffer, such as phosphate-buffered saline, Ringer's solution, or dextrose solution. It can further include other materials desirable from a commercial and user standpoint, including other buffers, diluents, filters, needles, syringes, and package inserts with instructions for use.

In some embodiments, any of the fusion proteins, gRNAs, and/or complexes described herein are provided as part of a pharmaceutical composition. In some embodiments, the pharmaceutical composition comprises any of the fusion proteins provided herein. In some embodiments, the pharmaceutical composition comprises any of the complexes provided herein. In some embodiments, the pharmaceutical composition comprises a ribonucleoprotein complex comprising an RNA-guided nuclease (e.g., Cas9) that forms a complex with a gRNA and a cationic lipid. In some embodiments pharmaceutical composition comprises a gRNA, a nucleic acid programmable DNA binding protein, a cationic lipid, and a pharmaceutically acceptable excipient. Pharmaceutical compositions can optionally comprise one or more additional therapeutically active substances.

In some embodiments, any of the fusion proteins, gRNAs, systems, and/or complexes described herein are provided as part of a pharmaceutical composition. In some embodiments, the pharmaceutical composition comprises any of the fusion proteins provided herein. In some embodiments, the pharmaceutical composition comprises any of the systems or complexes provided herein. In some embodiments, the pharmaceutical composition comprises a ribonucleoprotein complex comprising an RNA-guided nuclease (e.g., Cas9) or a fragment thereof that forms a complex with a gRNA and a cationic lipid. In some embodiments, the pharmaceutical composition comprises a ribonucleoprotein complex comprising multiple programmable DNA binding proteins (e.g. Cas9, Zinc Finger, TALE, TALE-N proteins or fragments thereof). The programmable DNA binding proteins may comprise nuclease activity, nickase activity, or no nuclease activity. In some embodiments, the pharmaceutical composition comprises a gRNA, a nucleic acid programmable DNA binding protein, a cationic lipid, and a pharmaceutically acceptable excipient. Pharmaceutical compositions as described herein may optionally comprise one or more additional therapeutically active substances.

In some embodiments, compositions provided herein are administered to a subject, for example, to a human subject, in order to effect a targeted genomic modification within the subject. In some embodiments, cells are obtained from the subject and contacted with any of the pharmaceutical compositions provided herein. In some embodiments, cells removed from a subject and contacted ex vivo with a pharmaceutical composition are re-introduced into the subject, optionally after the desired genomic modification has been effected or detected in the cells. Methods of delivering pharmaceutical compositions comprising nucleases are known, and are described, for example, in U.S. Pat. Nos. 6,453,242; 6,503,717; 6,534,261; 6,599,692; 6,607,882; 6,689,558; 6,824,978; 6,933,113; 6,979,539; 7,013,219; and 7,163,824, the disclosures of all of which are incorporated by reference herein in their entireties. Although the descriptions of pharmaceutical compositions provided herein are principally directed to pharmaceutical compositions which are suitable for administration to humans, it will be understood by the skilled artisan that such compositions are generally suitable for administration to animals or organisms of all sorts. Modification of pharmaceutical compositions suitable for administration to humans in order to render the compositions suitable for administration to various animals is well understood, and the ordinarily skilled veterinary pharmacologist can design and/or perform such modification with merely ordinary, if any, experimentation. Subjects to which administration of the pharmaceutical compositions is contemplated include, but are not limited to, humans and/or other primates;

mammals, domesticated animals, pets, and commercially relevant mammals such as cattle, pigs, horses, sheep, cats, dogs, mice, and/or rats; and/or birds, including commercially relevant birds such as chickens, ducks, geese, and/or turkeys.

Formulations of the pharmaceutical compositions described herein may be prepared by any method known or hereafter developed in the art of pharmacology. In general, such preparatory methods include the step of bringing the active ingredient(s) into association with an excipient and/or one or more other accessory ingredients, and then, if necessary and/or desirable, shaping and/or packaging the product into a desired single- or multi-dose unit.

Pharmaceutical formulations may additionally comprise a pharmaceutically acceptable excipient, which, as used herein, includes any and all solvents, dispersion media, diluents, or other liquid vehicles, dispersion or suspension aids, surface active agents, isotonic agents, thickening or emulsifying agents, preservatives, solid binders, lubricants and the like, as suited to the particular dosage form desired. Remington's The Science and Practice of Pharmacy, 21st Edition, A. R. Gennaro (Lippincott, Williams & Wilkins, Baltimore, MD, 2006; incorporated in its entirety herein by reference) discloses various excipients used in formulating pharmaceutical compositions and known techniques for the preparation thereof. See also PCT application PCT/US2010/055131 (Publication number WO2011053982 A8, filed Nov. 2, 2010), incorporated in its entirety herein by reference, for additional suitable methods, reagents, excipients and solvents for producing pharmaceutical compositions comprising a nuclease. Except insofar as any conventional excipient medium is incompatible with a substance or its derivatives, such as by producing any undesirable biological effect or otherwise interacting in a deleterious manner with any other component(s) of the pharmaceutical composition, its use is contemplated to be within the scope of this disclosure.

In some embodiments, compositions in accordance with the present invention may be used for treatment of any of a variety of diseases, disorders, and/or conditions.

Kits, Vectors, Cells

Various aspects of this disclosure provide kits comprising a nucleic acid construct comprising a nucleotide sequence encoding a nucleobase editor fusion protein comprising a deaminase, a SpnCas9 domain that is "split" into two fragments, the N-terminal fragment comprising one member of an intein system, and the C-terminal fragment comprising another member of an intein system, and an NLS; wherein the nucleotide sequence is under the control of a heterologous promoter that drives expression of the fusion protein.

Some aspects of this disclosure provide cells (e.g., bacteria, yeast, fungi, insects, plants, and animal cells) comprising any of the nucleobase editor/fusion proteins provided herein. In some embodiments, the cells comprise any of the nucleotides or vectors provided herein.

The practice of the present invention employs, unless otherwise indicated, conventional techniques of molecular biology (including recombinant techniques), microbiology, cell biology, biochemistry and immunology, which are well within the purview of the skilled artisan. Such techniques are explained fully in the literature, such as, "Molecular Cloning: A Laboratory Manual", second edition (Sambrook, 1989); "Oligonucleotide Synthesis" (Gait, 1984); "Animal Cell Culture" (Freshney, 1987); "Methods in Enzymology" "Handbook of Experimental Immunology" (Weir, 1996); "Gene Transfer Vectors for Mammalian Cells" (Miller and Calos, 1987); "Current Protocols in Molecular Biology" (Ausubel, 1987); "PCR: The Polymerase Chain Reaction", (Mullis, 1994); "Current Protocols in Immunology" (Coligan, 1991). These techniques are applicable to the production of the polynucleotides and polypeptides of the invention, and, as such, may be considered in making and practicing the invention. Particularly useful techniques for particular embodiments will be discussed in the sections that follow.

The following examples are put forth so as to provide those of ordinary skill in the art with a complete disclosure and description of how to make and use the assay, screening, and therapeutic methods of the invention, and are not intended to limit the scope of what the inventors regard as their invention.

EXAMPLES

Example 1: Split and Reassembled Cas9 Retains Function and Activity in a Base Editing System Viral vectors provide an attractive delivery system, but present technologies have limited capacity to deliver larger polynucleotides. To explore these challenges as they relate to base editing systems, a fusion protein was generated comprising, from N- to C-terminus, wild-type adenosine deaminase, TadA, fused to an evolved version of TadA, fused to nCas9 fused to a bipartite NLS. The fusion protein was split into N- and C-terminal fragments within unstructured regions of SpCas9 and delivered in two vectors together with a third plasmid encoding the guide RNA. The N and C-terminal fragments of nCas9 were fused to an intein-N and intein-C, respectively. The amino acid sequences encoding these inteins follow:

Cfa—N intein in fusions:
CLSYDTEILTVEYGFLPIGKIVEERIECTVYTVDKNGFVYTQPIAQWHNRGEQEVFEYCLED
GSIIRATKDHKFMTTDGQMLPIDEIFERGLDLKQVDGLP (SEQ ID NO: 68)

Cfa (GEP) —C intein in fusions:
MVKIISRKSLGTQNVYDIGVGEPHNFLLKNGLVASNC (SEQ ID NO: 117)
The polynucleotide sequences encoding these inteins follow:
Cfa—N intein in fusions:
TGCCTGAGCTACGATACCGAGATCCTGACCGTGGAATACGGCTTCCTGCCTATCGGCAAGAT
CGTCGAGGAACGGATCGAGTGCACAGTGTACACCGTGGATAAGAATGGCTTCGTGTACACCC
AGCCTATCGCTCAGTGGCACAACAGAGGCGAGCAAGAGGTGTTCGAGTACTGCCTGGAAGAT
GGCAGCATCATCCGGGCCACCAAGGACCACAAGTTTATGACCACCGACGGCCAGATGCTGCC
CATCGACGAGATCTTTGAGAGAGGCCTGGACCTGAAACAGGTGGACGGACTGCCT (SEQ
ID NO: 118)
Cfa (GEP) —C intein in fusions :
ATGGTCAAGATCATCAGCAGAAAGAGCCTGGGCACCCAGAACGTGTACGATATCGGAGTGGG
CGAGCCCCACAACTTTCTGCTCAAGAATGGCCTGGTGGCCAGCAACTGC (SEQ ID NO:
119)

Three regions of spCas9 were selected where the ABE fusion protein was split into N- and C-terminal fragments at Ala, Ser, Thr, or Cys residues within selected regions of SpCas9. These regions correspond to loop regions identified by Cas9 crystal structure analysis. The N-terminus of each fragment was fused to an intein-N and the C-terminus of each fragment was fused to an intein C at the amino acid positions indicated in FIGS. 2-4, i.e., S303, T310, T313, S355, A456, S460, A463, T466, S469, T472, T474, C574, S577, A589, and S590, which are indicated in Bold Capitals in the sequence below.

```
   1 mdkkysigld  igtnsvgwav itdeykvpsk  kfkvlgntdr hsikknliga  llfdsgetae
  61 atrlkrtarr  rytrrknric ylqeifsnem  akvddsffhr leesflveed  kkherhpifg
 121 nivdevayhe  kyptiyhlrk klvdstdkad  lrliylalah mikfrghfli  egdlnpdnsd
 181 vdklfiqlvq  tynqlfeenp inasgvdaka  ilsarlsksr rlenliaqlp  gekknglfgn
 241 lialslgltp  nfksnfdlae daklqlskdt  ydddldnlla qigdqyadlf  laaknlsdai
 301 llSdilrvnT  eiTkaplsas mikrydehhq  dltllkalvr qqlpekykei  ffdqSkngya
 361 gyidggasqe  efykfikpil ekmdgteell  vklnredllr kqrtfdngsi  phqihlgelh
 421 ailrrqedfy  pflkdnreki ekiltfripy  yvgplArgnS rfAwmTrkSe  eTiTpwnfee
 481 vvdkgasaqs  fiermtnfdk nlpnekvlpk  hsllyeyftv yneltkvkyv  tegmrkpafl
 541 sgeqkkaivd  llfktnrkvt vkqlkedyfk  kieCfdSvei sgvedrfnAS  lgtyhdllki
 601 ikdkdfldne  enedilediv ltltlfedre  mieerlktya hlfddkvmkq  lkrrrytgwg
 661 rlsrklingi  rdkqsgktil dflksdgfan  rnfmqlihdd sltfkediqk  aqvsgqgdsl
 721 hehianlags  paikkgilqt vkvvdelvkv  mgrhkpeniv iemarenqtt  qkgqknsrer
 781 mkrieegike  lgsqilkehp ventqlqnek  lylyylqngr dmyvdgeldi  nrlsdydvdh
 841 ivpqsflkdd  sidnkvltrs dknrgksdnv  pseevvkkmk nywrqllnak  litqrkfdnl
 901 tkaergglse  ldkagfikrq lvetrqitkh  vaqildsrmn tkydendkli  revkvitlks
 961 klvsdfrkdf  qfykvreinn yhhahdayln  avvgtalikk ypklesefvy  gdykvydvrk
1021 miakseqeig  katakyffys nimnffktei  tlangeirkr plietngetg  eivwdkgrdf
1081 atvrkvlsmp  qvnivkktev qtggfskesi  lpkrnsdkli arkkdwdpkk  yggfdsptva
1141 ysvlvvakve  kgkskklksv kellgitime  rssfeknpid fleakgykev  kkdliiklpk
1201 yslfelengr  krmlasagel qkgnelalps  kyvnflylas hyeklkgspe  dneqkqlfve
1261 qhkhyldeii  eqisefskrv iladanldkv  lsaynkhrdk pireqaenii  hlftltnlga
1321 paafkyfdtt  idrkrytstk evldatlihq  sitglyetri dlsqlggd              (SEQ ID NO: 16)
```

HEK 293 cells were transfected with the plasmids. The fusion protein was reconstituted using the split intein system when the N- and C-terminal fragments were expressed and spliced together in the cultured cells where they associated with the guide RNA, thereby generating a functional nucleobase editing system. The sequences of the guide RNAs used follows:

20-nt guide protospacer (PAM: AGG)
(SEQ ID NO: 120)
5'-TGTCGAAGTTCGCCCTGGAG-3'

The hammerhead ribozyme (sequence below) is fused to the 5'-end of the protospacer above:
(SEQ ID NO: 121)
5'-GTCGACACTGATGAGTCCGTGAGGACGAAACGAGTAAGCTCGTC-3'

21-nt ABCA4 guide protospacer (PAM: AGG)
(SEQ ID NO: 122)
5'-GTGTCGAAGTTCGCCCTGGAG-3'

HEK2 guide protospacer (PAM: GGG)
(SEQ ID NO: 123)
5'-GAACACAAAGCATAGACTGC-3'

Full guide sequence is the protospacer sequence appended directly to the 5'-side of the following sequence:
(SEQ ID NO: 124)
5'-GTTTTAGAGCTAGAAATAGCAAGTTAAAATAAGGCTAGTCCGTTATC
AACTTGAAAAAGTGGCACCGAGTCGGTGCTTTTTT-3'

Full guide transcripts are the following prior to hammerhead cleavage in the case of the 20-nt guide:
20-nt guide
(SEQ ID NO: 125)
5'-GTCGACACTGATGAGTCCGTGAGGACGAAACGAGTAAGCTCGTCTGT
CGAAGTTCGCCCTGGAGGTTTTAGAGCTAGAAATAGCAAGTTAAAATAAG

```
                        -continued
GCTAGTCCGTTATCAACTTGAAAAAGTGGCACCGAGTCGGTGCTTTTTT-

3'

21-nt guide
                                            (SEQ ID NO: 126)
5'-GTGTCGAAGTTCGCCCTGGAGGTTTTAGAGCTAGAAATAGCAAGTTA

AAATAAGGCTAGTCCGTTATCAACTTGAAAAAGTGGCACCGAGTCGGTGC

TTTTTT-3'

HEK2 guide
                                            (SEQ ID NO: 127)
5'-GAACACAAAGCATAGACTGCGTTTTAGAGCTAGAAATAGCAAGTTAA

AATAAGGCTAGTCCGTTATCAACTTGAAAAAGTGGCACCGAGTCGGTGCT

TTTTT-3'
```

Figure 3:
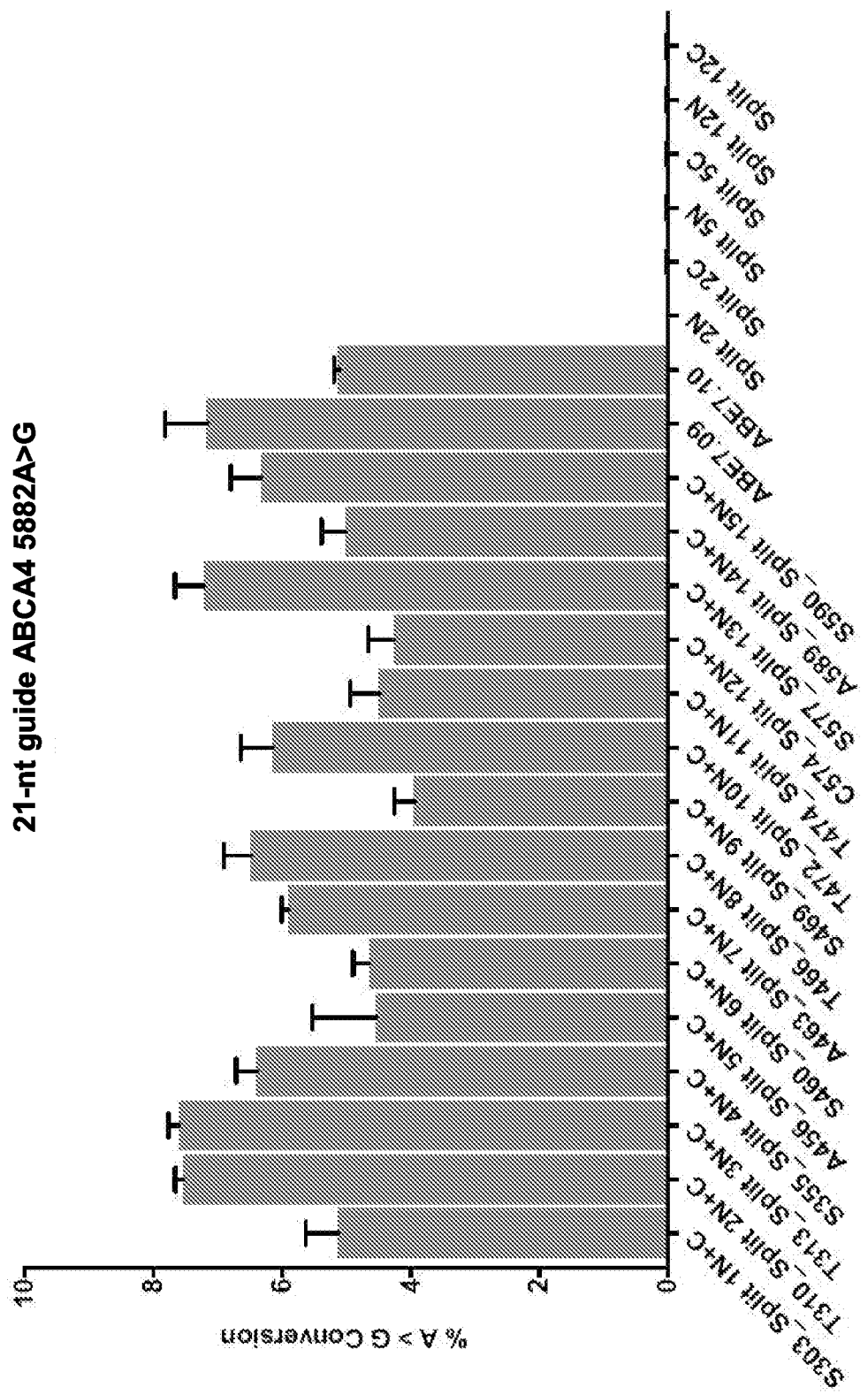
FIG. 3 is a graph confirming base editing activity with the 21-nt guide as described in FIG. 2. Note the experiments in FIG. 3 were performed in a different format from those in FIG. 2. All of the reconstituted ABEs showed good base editing activity. This activity was dependent on the presence of both the N- and C-terminal fragments of nCas9. When only the N- or C-terminal fragment of nCas9 was expressed, no activity was observed. The activity of the reconstituted ABE was compared to the activity of control ABE7.09 and ABE7.10 fusion proteins.
Figure 4:
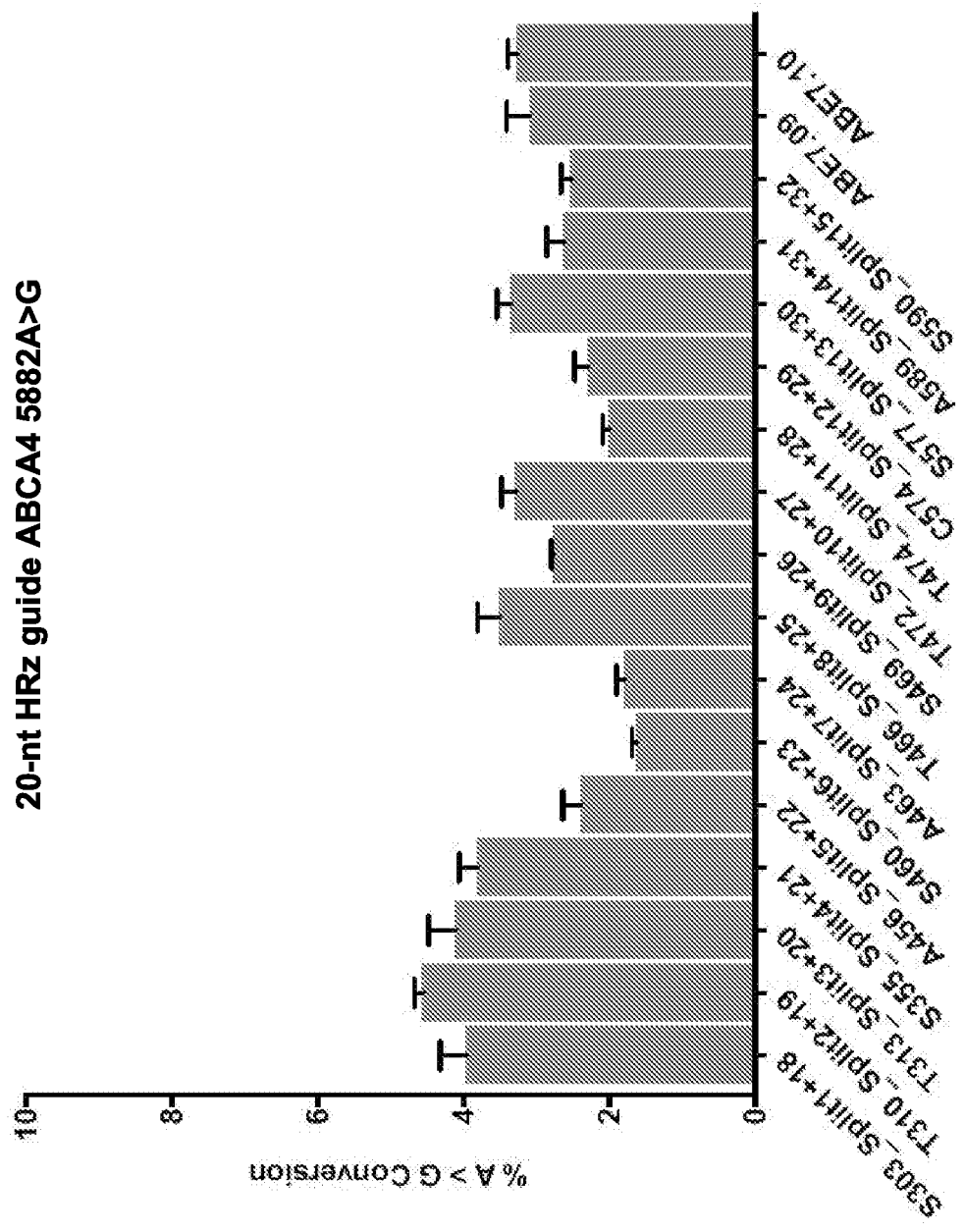
FIG. 4 is a graph quantitating base editing activity as described in FIG. 2.

Base-editing activity was assayed by detecting alterations in the ABCA4 gene. Sequence changes following base editing were detected using high throughput sequencing (HTS). The activity of the reconstituted ABE was compared to the activity of ABE7.10, which was expressed in the same cell type, but delivered using a single plasmid vector. The results of these experiments are shown in FIG. 2-4.

Figure 2:
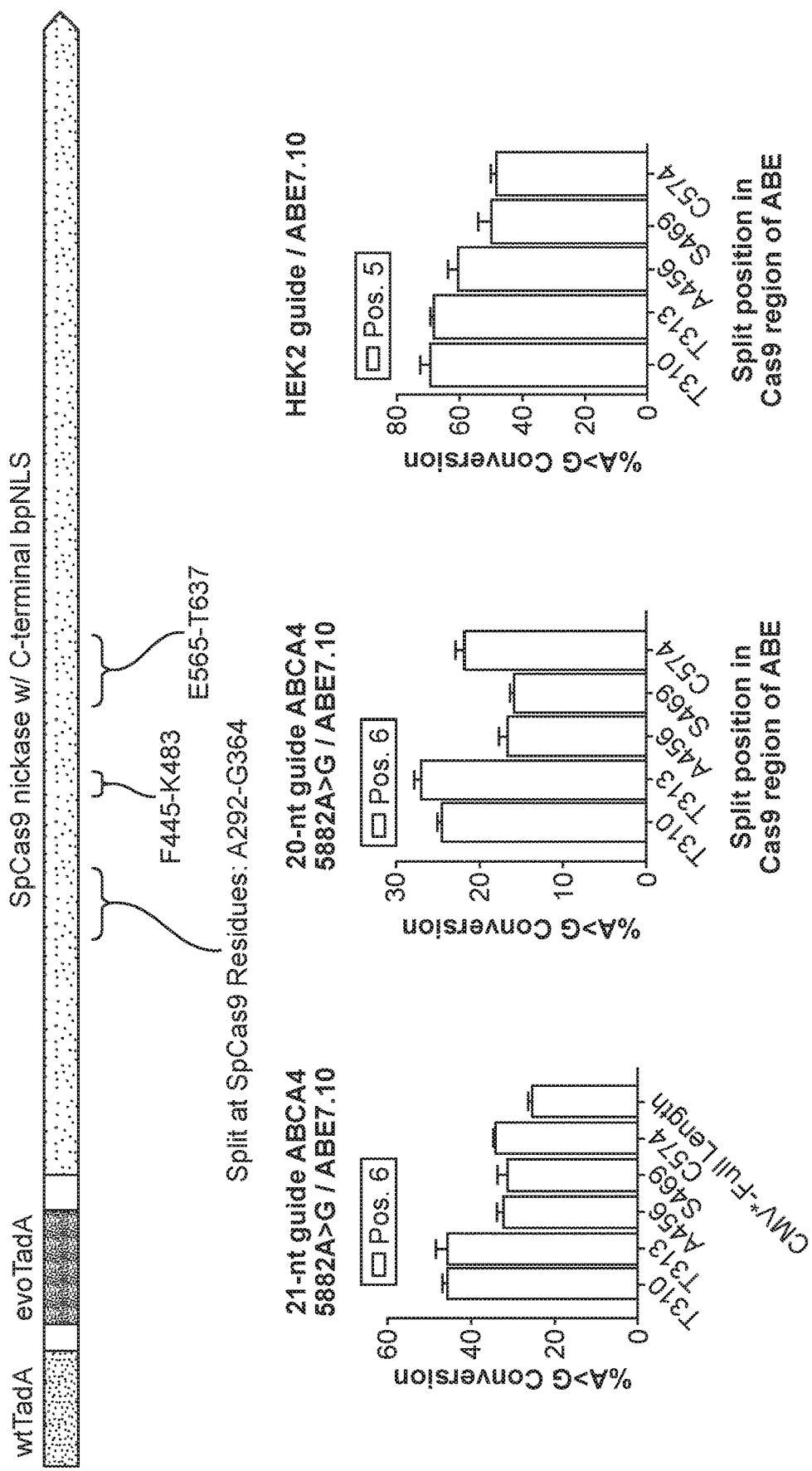
FIG. 2 reproduces the fusion protein described in FIG. 1 and provides three graphs, which quantitate the base editing activity of a base editing system that includes a nucleobase editor fusion protein (i.e., ABE) comprising a spliced nCas9. ABE was split at the indicated amino acid positions (e.g., T310, T313, A456, S469, and C574 with reference to SpCas9 amino acid sequence). The N- and C-terminal fragments of ABE were fused to an intein-N and intein-C, respectively. These fragments and the indicated guide RNA, were each expressed on separate plasmids in cultured HEK 293 cells that express the protein having an ABCA4 gene with a 5882G>A mutation. The base editing activity of the reconstituted ABE on the ABCA4 5882A>G target was compared to the activity of a control ABE. Base editing activity was dependent on the presence of both the N- and C-terminal fragments of ABE. When only one of the N- or C-terminal fragments of ABE was expressed no base editing activity was observed.

FIG. 2 shows the effect of splitting ABE into two fragments within the first region of Cas9, amino acids 292-365, on base editing activity of the reconstituted fusion protein. Surprisingly, the reconstituted base editor showed comparable activity to a control base editor expressed in a single vector in the presence of 21-nucleotide, 20-nucleotide and a HEK2 guide RNA.

The effect of splitting the ABE into two fragments at amino acids within the following regions: F445-K483 and E565-T637 of SpCas9 on base editing activity of the reconstituted fusion protein are shown at FIG. 3. Regardless of the position where the ABE was split, when the fusion protein was reconstituted using the intein system, it showed comparable activity to ABE7.10. When only the N- or C-terminal portion of the fragmented fusion protein was expressed, no base editing activity was observed. Thus, editing was dependent on the presence of both the N- and C-terminal fragments of Cas9. As shown in FIG. 4, fusion proteins reconstituted using the split intein system also showed activity when the 20-nucleotide guide RNA included a hammer head ribozyme. The experiments in FIG. 2 were performed in a different format from those in FIGS. 3 and 4.

The results reported herein were carried out using the following methods and materials.

A base editing system was transfected into cultured HEK 293T cells that contain a lentiviral integrated ABCA4 polynucleotide containing a 5882G>A mutation (HEK/ABCA4/5882G>A cells). Transfection was carried out using 1.5 µL of Lipofectamine 2000 per µg of DNA transfected. The base editing system includes a fusion protein, ABE7.10, comprising wild-type adenosine deaminase, TadA, fused to an evolved version of TadA, fused to SpCas9 fused to a C-terminal bipartite NLS.

N- and C-terminal fragments of ABE7.10 were each cloned into pCAG plasmids where their expression was driven by the CAG promoter. ABE7.10 under the control of the CMV promoter was expressed in HEK 293T cells as a reference. Each of the aforementioned nucleic acid sequences was codon optimized. Cells were transfected with three plasmids, a first plasmid encoding the N-terminal fragment of ABE7.10 fused to an intein-N, a second plasmid encoding the C-terminal fragment of ABE7.10 fused to an intein-C, and a plasmid expressing the guide RNA. The two plasmids encoding the base editor were transfected in equimolar ratios (9.05×10−14 mol of each half; 863 ng total editor DNA). With regard to the guide, 127 ng of guide plasmid (9.05×10^−14 mol) was used in each transfection. Control: 490 ng (9.05×10-14 mol) of pCMV-ABE7.10 with bipartite NLS (C-terminal) and GeneArt codon optimization+pNMG-B8 (a non-relevant plasmid that does not express in mammalian cells used to normalize amount of DNA transfected).

The polynucleotide and amino acid sequences encoding full length ABE7.10 and the ABE7.10 "split" Cas9s depicted in FIGS. 2-4 follow:

```
Intact ABE7.10:
                                                            (SEQ ID NO: 128)
ATGAGCGAGGTGGAATTCAGCCACGAGTACTGGATGCGGCACGCCCTGACACTGGCCAAAAG

AGCTTGGGACGAGAGGGAAGTGCCTGTGGGAGCTGTGCTGGTGCACAACAACAGAGTGATCG

GCGAAGGCTGGAACAGACCCATCGGCAGACACGATCCTACAGCTCACGCCGAGATCATGGCC

CTGAGACAAGGCGGACTGGTCATGCAGAACTACCGGCTGATCGACGCCACACTGTACGTGAC

CCTGGAACCTTGCGTGATGTGTGCCGGCGCTATGATCCACAGCAGAATCGGCAGAGTGGTGT

TCGGCGCCAGAGATGCCAAAACAGGCGCTGCCGGAAGCCTGATGGATGTGCTGCATCACCCC

GGCATGAACCACAGAGTGGAAATCACCGAGGGCATCCTGGCCGATGAATGTGCCGCTCTGCT

GAGCGACTTCTTCCGGATGCGGCGGCAAGAGATCAAGGCCCAGAAGAAGGCCCAGTCCAGCA

CAGATAGCGGCGGATCTAGCGGAGGCAGCTCTGGATCTGAGACACCTGGCACAAGCGAGAGC

GCCACACCTGAAAGTTCTGGCGGTTCTTCTGGCGGCAGCAGCGAGGTCGAGTTCTCTCACGA

ATATTGGATGAGACACGCTCTCACCCTGGCTAAGAGAGCCAGGGACGAAAGAGAGGTGCCAG

TTGGCGCTGTCCTGGTGTTGAACAATCGCGTCATCGGAGAAGGATGGAATCGCGCCATTGGC

CTGCACGATCCAACCGCACATGCCGAAATTATGGCTCTGCGGCAAGGCGGCCTCGTGATGCA

AAATTACAGACTGATCGATGCTACCCTCTACGTCACCTTCGAGCCCTGTGTCATGTGTGCTG
```

-continued

```
GGGCAATGATTCACTCCCGGATTGGCCGCGTGGTGTTTGGAGTGCGGAATGCCAAGACTGGC
GCCGCTGGATCTCTGATGGACGTCCTGCACTATCCTGGGATGAACCACCGGGTCGAGATCAC
AGAGGGAATTCTGGCTGACGAGTGCGCTGCCCTGCTGTGCTACTTCTTTAGAATGCCCAGAC
AGGTGTTCAACGCCCAGAAAAAAGCTCAGAGCAGCACCGATTCCGGCGGAAGCAGCGGAGGA
TCTTCTGGAAGCGAAACCCCAGGCACCAGCGAGTCTGCCACACCAGAATCATCTGGCGGTAG
CTCCGGCGGCAGCGACAAGAAGTATTCTATCGGACTGGCCATCGGCACCAACTCTGTTGGAT
GGGCCGTGATCACCGACGAGTACAAGGTGCCCAGCAAGAAATTCAAGGTGCTGGGCAACACC
GACAGGCACAGCATCAAGAAGAACCTGATCGGCGCACTGCTGTTCGACTCTGGCGAAACAGC
CGAGGCCACCAGACTGAAGAGAACAGCCCGCAGACGGTACACCAGAAGAAAGAACCGGATCT
GCTACCTCCAAGAGATCTTCAGCAACGAGATGGCCAAGGTGGACGACAGCTTCTTCCACAGA
CTGGAAGAGTCCTTCCTGGTGGAAGAGGACAAGAAGCACGAGAGACACCCCATCTTCGGCAA
CATCGTGGACGAGGTGGCCTACCACGAGAAGTACCCCACCATCTACCACCTGAGAAAGAAAC
TGGTGGACAGCACCGACAAGGCCGACCTGAGACTGATCTATCTGGCCCTGGCTCACATGATC
AAGTTCCGGGGCCACTTCCTGATCGAGGGCGACCTGAATCCTGACAACAGCGACGTGGACAA
GCTGTTCATCCAGCTGGTGCAGACCTACAACCAGCTGTTCGAGGAAAACCCCATCAACGCCA
GCGGAGTGGATGCCAAGGCCATCCTGTCTGCCAGACTGAGCAAGAGCAGACGGCTGGAAAAT
CTGATCGCCCAGCTGCCTGGCGAGAAGAAGAATGGCCTGTTCGGCAACCTGATTGCCCTGAG
CCTGGGCCTGACACCTAACTTCAAGAGCAACTTCGACCTGGCCGAGGACGCCAAACTGCAGC
TGAGCAAGGACACCTACGACGACGACCTGGACAATCTGCTGGCCCAGATCGGCGATCAGTAC
GCCGACTTGTTTCTGGCCGCCAAGAATCTGAGCGACGCCATCCTGCTGTCCGACATCCTGAG
AGTGAACACCGAGATCACCAAGGCACCTCTGAGCGCCTCTATGATCAAGAGATACGACGAGC
ACCACCAGGATCTGACCCTGCTGAAGGCCCTCGTTAGACAGCAGCTGCCAGAGAAGTACAAA
GAGATTTTCTTCGACCAGAGCAAGAACGGCTACGCCGGCTACATTGATGGCGGAGCCAGCCA
AGAGGAATTCTACAAGTTCATCAAGCCCATCCTCGAGAAGATGGACGGCACCGAGGAACTGC
TGGTCAAGCTGAACAGAGAGGACCTGCTGAGAAAGCAGAGAACCTTCGACAACGGCAGCATC
CCTCACCAGATCCACCTGGGAGAACTGCACGCCATTCTGCGGAGACAAGAGGACTTTTACCC
ATTCCTGAAGGACAACCGGGAAAAGATCGAGAAAATCCTGACCTTCAGGATCCCCTACTACG
TGGGACCACTGGCCAGAGGCAATAGCAGATTCGCCTGGATGACCAGAAAGAGCGAGGAAACC
ATCACTCCCTGGAACTTCGAGGAAGTGGTGGACAAGGGCGCCAGCGCTCAGTCCTTCATCGA
GCGGATGACCAACTTCGATAAGAACCTGCCTAACGAGAAGGTGCTGCCCAAGCACAGCCTGC
TGTACGAGTACTTCACCGTGTACAACGAGCTGACCAAAGTGAAATACGTGACCGAGGGAATG
AGAAAGCCCGCCTTTCTGAGCGGCGAGCAGAAAAAGGCCATCGTGGATCTGCTGTTCAAGAC
CAACCGGAAAGTGACCGTGAAGCAGCTGAAAGAGGACTACTTCAAGAAAATCGAGTGCTTCG
ACAGCGTCGAGATCTCCGGCGTGGAAGATCGGTTCAATGCCAGCCTGGGCACATACCACGAT
CTGCTGAAAATTATCAAGGACAAGGACTTCCTGGACAACGAAGAGAACGAGGACATCCTTGA
GGACATCGTGCTGACACTGACCCTGTTTGAGGACAGAGAGATGATCGAGGAACGGCTGAAAA
CATACGCCCACCTGTTCGACGACAAAGTGATGAAGCAACTGAAGCGGCGGAGATACACCGGC
TGGGGCAGACTGTCTCGGAAGCTGATCAACGGCATCCGGGATAAGCAGTCCGGCAAGACCAT
CCTGGACTTTCTGAAGTCCGACGGCTTCGCCAACAGAAACTTCATGCAGCTGATTCACGACG
ACAGCCTCACCTTCAAAGAGGATATCCAGAAAGCCCAGGTGTCCGGCCAGGGCGATTCTCTG
CATGAGCACATTGCCAACCTGGCCGGCTCTCCCGCCATTAAGAAAGGCATCCTGCAGACAGT
```

-continued

```
GAAGGTGGTGGACGAGCTTGTGAAAGTGATGGGCAGACACAAGCCCGAGAACATCGTGATCG

AAATGGCCAGAGAGAACCAGACCACACAGAAGGGACAGAAGAACAGCCGCGAGAGAATGAAG

CGGATCGAAGAGGGCATCAAAGAGCTGGGCAGCCAGATCCTGAAAGAACACCCCGTGGAAAA

CACCCAGCTGCAGAACGAGAAGCTGTACCTGTACTACCTGCAGAATGGACGGGATATGTACG

TGGACCAAGAGCTGGACATCAACAGACTGTCCGACTACGATGTGGACCATATCGTGCCCCAG

TCTTTTCTGAAGGACGACTCCATCGACAACAAGGTCCTGACCAGATCCGACAAGAATCGGGG

CAAGAGCGACAACGTGCCCTCCGAAGAGGTGGTCAAGAAGATGAAGAACTACTGGCGACAGC

TGCTGAACGCCAAGCTGATTACCCAGCGGAAGTTCGACAATCTGACCAAGGCCGAAAGAGGC

GGCCTGAGCGAACTGGATAAGGCCGGCTTCATCAAGAGACAGCTGGTGGAAACCCGGCAGAT

CACAAAGCACGTGGCACAGATTCTGGACTCTCGGATGAACACTAAGTACGACGAGAACGACA

AACTGATCCGCGAAGTGAAAGTCATCACCCTGAAGTCCAAGCTGGTGTCCGATTTCCGGAAG

GATTTCCAGTTCTACAAAGTGCGCGAGATCAACAACTACCATCACGCCCACGACGCCTACCT

GAATGCCGTTGTTGGAACAGCCCTGATCAAAAAGTACCCTAAGCTGGAAAGCGAGTTCGTGT

ACGGCGACTACAAGGTGTACGACGTGCGGAAGATGATCGCCAAGAGCGAGCAAGAGATTGGC

AAGGCAACCGCCAAGTACTTCTTCTACAGCAACATCATGAACTTTTTCAAGACAGAGATCAC

CCTCGCCAACGGCGAGATCAGAAAGCGGCCTCTGATCGAGACAAACGGCGAAACCGGCGAGA

TTGTGTGGGATAAGGGCAGAGACTTTGCCACAGTGCGGAAAGTGCTGAGCATGCCCCAAGTG

AATATCGTGAAGAAAACCGAGGTGCAGACAGGCGGCTTCAGCAAAGAGTCTATCCTGCCTAA

GCGGAACTCCGACAAGCTGATCGCCAGAAAGAAGGACTGGGACCCCAAGAAGTACGGCGGCT

TCGATTCTCCTACCGTGGCCTATAGCGTGCTGGTGGTGGCCAAAGTGGAAAAGGGCAAGTCC

AAGAAACTCAAGAGCGTGAAAGAGCTGCTGGGGATCACCATCATGGAAAGAAGCAGCTTCGA

GAAGAATCCGATCGATTTCCTCGAGGCCAAGGGCTACAAAGAAGTGAAAAAGGACCTGATCA

TCAAGCTCCCCAAGTACTCCCTGTTCGAGCTGGAAAACGGCCGGAAGAGAATGCTGGCCTCT

GCTGGCGAACTGCAGAAGGGAAACGAACTGGCCCTGCCTAGCAAATATGTGAACTTCCTGTA

CCTGGCCAGCCACTATGAGAAGCTGAAGGGCAGCCCCGAGGACAATGAGCAAAAGCAGCTGT

TTGTGGAACAGCACAAGCACTACCTGGACGAGATCATCGAGCAGATCAGCGAGTTTAGCAAG

AGAGTGATTCTGGCCGACGCCAATCTGGACAAAGTGCTGTCCGCCTACAACAAGCACCGGGA

CAAGCCTATCAGAGAGCAGGCCGAGAATATCATCCACCTGTTTACCCTGACCAACCTGGGAG

CCCCTGCCGCCTTCAAGTACTTTGACACCACCATCGACCGGAAGCGGTACACCTCCACCAAA

GAGGTGCTGGACGCCACTCTGATCCACCAGTCTATCACCGGCCTGTACGAGACACGGATCGA

CCTGTCTCAACTCGGAGGCGACGAAGGCGCCGATAAGAGAACCGCCGATGGCTCTGAGTTCG

AGAGCCCCAAGAAAAAGCGCAAAGTGTGA
```

ABE7.10_Cfa-N_Split_S303C:

(SEQ ID NO: 129)
```
ATGAGCGAGGTGGAATTCAGCCACGAGTACTGGATGCGGCACGCCCTGACACTGGCCAAAAG

AGCTTGGGACGAGAGGGAAGTGCCTGTGGGAGCTGTGCTGGTGCACAACAACAGAGTGATCG

GCGAAGGCTGGAACAGACCCATCGGCAGACACGATCCTACAGCTCACGCCGAGATCATGGCC

CTGAGACAAGGCGGACTGGTCATGCAGAACTACCGGCTGATCGACGCCACACTGTACGTGAC

CCTGGAACCTTGCGTGATGTGTGCCGGCGCTATGATCCACAGCAGAATCGGCAGAGTGGTGT

TCGGCGCCAGAGATGCCAAAACAGGCGCTGCCGGAAGCCTGATGGATGTGCTGCATCACCCC

GGCATGAACCACAGAGTGGAAATCACCGAGGGCATCCTGGCCGATGAATGTGCCGCTCTGCT
```

-continued

```
GAGCGACTTCTTCCGGATGCGGCGGCAAGAGATCAAGGCCCAGAAGAAGGCCCAGTCCAGCA
CAGATAGCGGCGGATCTAGCGGAGGCAGCTCTGGATCTGAGACACCTGGCACAAGCGAGAGC
GCCACACCTGAAAGTTCTGGCGGTTCTTCTGGCGGCAGCAGCGAGGTCGAGTTCTCTCACGA
ATATTGGATGAGACACGCTCTCACCCTGGCTAAGAGAGCCAGGGACGAAAGAGAGGTGCCAG
TTGGCGCTGTCCTGGTGTTGAACAATCGCGTCATCGGAGAAGGATGGAATCGCGCCATTGGC
CTGCACGATCCAACCGCACATGCCGAAATTATGGCTCTGCGGCAAGGCGGCCTCGTGATGCA
AAATTACAGACTGATCGATGCTACCCTCTACGTCACCTTCGAGCCCTGTGTCATGTGTGCTG
GGGCAATGATTCACTCCCGGATTGGCCGCGTGGTGTTTGGAGTGCGGAATGCCAAGACTGGC
GCCGCTGGATCTCTGATGGACGTCCTGCACTATCCTGGGATGAACCACCGGGTCGAGATCAC
AGAGGGAATTCTGGCTGACGAGTGCGCTGCCCTGCTGTGCTACTTCTTTAGAATGCCCAGAC
AGGTGTTCAACGCCCAGAAAAAAGCTCAGAGCAGCACCGATTCCGGCGGAAGCAGCGGAGGA
TCTTCTGGAAGCGAAACCCCAGGCACCAGCGAGTCTGCCACACCAGAATCATCTGGCGGTAG
CTCCGGCGGCAGCGACAAGAAGTATTCTATCGGACTGGCCATCGGCACCAACTCTGTTGGAT
GGGCCGTGATCACCGACGAGTACAAGGTGCCCAGCAAGAAATTCAAGGTGCTGGGCAACACC
GACAGGCACAGCATCAAGAAGAACCTGATCGGCGCACTGCTGTTCGACTCTGGCGAAACAGC
CGAGGCCACCAGACTGAAGAGAACAGCCCGCAGACGGTACACCAGAAGAAAGAACCGGATCT
GCTACCTCCAAGAGATCTTCAGCAACGAGATGGCCAAGGTGGACGACAGCTTCTTCCACAGA
CTGGAAGAGTCCTTCCTGGTGGAAGAGGACAAGAAGCACGAGAGACACCCCATCTTCGGCAA
CATCGTGGACGAGGTGGCCTACCACGAGAAGTACCCCACCATCTACCACCTGAGAAAGAAAC
TGGTGGACAGCACCGACAAGGCCGACCTGAGACTGATCTATCTGGCCCTGGCTCACATGATC
AAGTTCCGGGGCCACTTCCTGATCGAGGGCGACCTGAATCCTGACAACAGCGACGTGGACAA
GCTGTTCATCCAGCTGGTGCAGACCTACAACCAGCTGTTCGAGGAAAACCCCATCAACGCCA
GCGGAGTGGATGCCAAGGCCATCCTGTCTGCCAGACTGAGCAAGAGCAGACGGCTGGAAAAT
CTGATCGCCCAGCTGCCTGGCGAGAAGAAGAATGGCCTGTTCGGCAACCTGATTGCCCTGAG
CCTGGGCCTGACACCTAACTTCAAGAGCAACTTCGACCTGGCCGAGGACGCCAAACTGCAGC
TGAGCAAGGACACCTACGACGACGACCTGGACAATCTGCTGGCCCAGATCGGCGATCAGTAC
GCCGACTTGTTTCTGGCCGCCAAGAATCTGAGCGACGCCATCCTGCTGTGCCTGAGCTACGA
TACCGAGATCCTGACCGTGGAATACGGCTTCCTGCCTATCGGCAAGATCGTCGAGGAACGGA
TCGAGTGCACAGTGTACACCGTGGATAAGAATGGCTTCGTGTACACCCAGCCTATCGCTCAG
TGGCACAACAGAGGCGAGCAAGAGGTGTTCGAGTACTGCCTGGAAGATGGCAGCATCATCCG
GGCCACCAAGGACCACAAGTTTATGACCACCGACGGCCAGATGCTGCCCATCGACGAGATCT
TTGAGAGAGGCCTGGACCTGAAACAGGTGGACGGACTGCCTTGA
```

ABE7.10_Cfa-N_Split_T310C:
(SEQ ID NO: 130)

```
ATGAGCGAGGTGGAATTCAGCCACGAGTACTGGATGCGGCACGCCCTGACACTGGCCAAAAG
AGCTTGGGACGAGAGGGAAGTGCCTGTGGGAGCTGTGCTGGTGCACAACAACAGAGTGATCG
GCGAAGGCTGGAACAGACCCATCGGCAGACACGATCCTACAGCTCACGCCGAGATCATGGCC
CTGAGACAAGGCGGACTGGTCATGCAGAACTACCGGCTGATCGACGCCACACTGTACGTGAC
CCTGGAACCTTGCGTGATGTGTGCCGGCGCTATGATCCACAGCAGAATCGGCAGAGTGGTGT
TCGGCGCCAGAGATGCCAAAACAGGCGCTGCCGGAAGCCTGATGGATGTGCTGCATCACCCC
GGCATGAACCACAGAGTGGAAATCACCGAGGGCATCCTGGCCGATGAATGTGCCGCTCTGCT
GAGCGACTTCTTCCGGATGCGGCGGCAAGAGATCAAGGCCCAGAAGAAGGCCCAGTCCAGCA
```

```
CAGATAGCGGCGGATCTAGCGGAGGCAGCTCTGGATCTGAGACACCTGGCACAAGCGAGAGC

GCCACACCTGAAAGTTCTGGCGGTTCTTCTGGCGGCAGCAGCGAGGTCGAGTTCTCTCACGA

ATATTGGATGAGACACGCTCTCACCCTGGCTAAGAGAGCCAGGGACGAAAGAGAGGTGCCAG

TTGGCGCTGTCCTGGTGTTGAACAATCGCGTCATCGGAGAAGGATGGAATCGCGCCATTGGC

CTGCACGATCCAACCGCACATGCCGAAATTATGGCTCTGCGGCAAGGCGGCCTCGTGATGCA

AAATTACAGACTGATCGATGCTACCCTCTACGTCACCTTCGAGCCCTGTGTCATGTGTGCTG

GGGCAATGATTCACTCCCGGATTGGCCGCGTGGTGTTTGGAGTGCGGAATGCCAAGACTGGC

GCCGCTGGATCTCTGATGGACGTCCTGCACTATCCTGGGATGAACCACCGGGTCGAGATCAC

AGAGGGAATTCTGGCTGACGAGTGCGCTGCCCTGCTGTGCTACTTCTTTAGAATGCCCAGAC

AGGTGTTCAACGCCCAGAAAAAGCTCAGAGCAGCACCGATTCCGGCGGAAGCAGCGGAGGA

TCTTCTGGAAGCGAAACCCCAGGCACCAGCGAGTCTGCCACACCAGAATCATCTGGCGGTAG

CTCCGGCGGCAGCGACAAGAAGTATTCTATCGGACTGGCCATCGGCACCAACTCTGTTGGAT

GGGCCGTGATCACCGACGAGTACAAGGTGCCCAGCAAGAAATTCAAGGTGCTGGGCAACACC

GACAGGCACAGCATCAAGAAGAACCTGATCGGCGCACTGCTGTTCGACTCTGGCGAAACAGC

CGAGGCCACCAGACTGAAGAGAACAGCCCGCAGACGGTACACCAGAAGAAAGAACCGGATCT

GCTACCTCCAAGAGATCTTCAGCAACGAGATGGCCAAGGTGGACGACAGCTTCTTCCACAGA

CTGGAAGAGTCCTTCCTGGTGGAAGAGGACAAGAAGCACGAGAGACACCCCATCTTCGGCAA

CATCGTGGACGAGGTGGCCTACCACGAGAAGTACCCCACCATCTACCACCTGAGAAAGAAAC

TGGTGGACAGCACCGACAAGGCCGACCTGAGACTGATCTATCTGGCCCTGGCTCACATGATC

AAGTTCCGGGGCCACTTCCTGATCGAGGGCGACCTGAATCCTGACAACAGCGACGTGGACAA

GCTGTTCATCCAGCTGGTGCAGACCTACAACCAGCTGTTCGAGGAAAACCCCATCAACGCCA

GCGGAGTGGATGCCAAGGCCATCCTGTCTGCCAGACTGAGCAAGAGCAGACGGCTGGAAAAT

CTGATCGCCCAGCTGCCTGGCGAGAAGAAGAATGGCCTGTTCGGCAACCTGATTGCCCTGAG

CCTGGGCCTGACACCTAACTTCAAGAGCAACTTCGACCTGGCCGAGGACGCCAAACTGCAGC

TGAGCAAGGACACCTACGACGACGACCTGGACAATCTGCTGGCCCAGATCGGCGATCAGTAC

GCCGACTTGTTTCTGGCCGCCAAGAATCTGAGCGACGCCATCCTGCTGTCCGACATCCTGAG

AGTGAACTGCCTGAGCTACGATACCGAGATCCTGACCGTGGAATACGGCTTCCTGCCTATCG

GCAAGATCGTCGAGGAACGGATCGAGTGCACAGTGTACACCGTGGATAAGAATGGCTTCGTG

TACACCCAGCCTATCGCTCAGTGGCACAACAGAGGCGAGCAAGAGGTGTTCGAGTACTGCCT

GGAAGATGGCAGCATCATCCGGGCCACCAAGGACCACAAGTTTATGACCACCGACGGCCAGA

TGCTGCCCATCGACGAGATCTTTGAGAGAGGCCTGGACCTGAAACAGGTGGACGGACTGCCT

TGA

ABE7.10_Cfa-N_Split_T313C:
                                                      (SEQ ID NO: 131)
ATGAGCGAGGTGGAATTCAGCCACGAGTACTGGATGCGGCACGCCCTGACACTGGCCAAAAG

AGCTTGGGACGAGAGGGAAGTGCCTGTGGGAGCTGTGCTGGTGCACAACAACAGAGTGATCG

GCGAAGGCTGGAACAGACCCATCGGCAGACACGATCCTACAGCTCACGCCGAGATCATGGCC

CTGAGACAAGGCGGACTGGTCATGCAGAACTACCGGCTGATCGACGCCACACTGTACGTGAC

CCTGGAACCTTGCGTGATGTGTGCCGGCGCTATGATCCACAGCAGAATCGGCAGAGTGGTGT

TCGGCGCCAGAGATGCCAAAACAGGCGCTGCCGGAAGCCTGATGGATGTGCTGCATCACCCC

GGCATGAACCACAGAGTGGAAATCACCGAGGGCATCCTGGCCGATGAATGTGCCGCTCTGCT
```

-continued

```
GAGCGACTTCTTCCGGATGCGGCGGCAAGAGATCAAGGCCCAGAAGAAGGCCCAGTCCAGCA
CAGATAGCGGCGGATCTAGCGGAGGCAGCTCTGGATCTGAGACACCTGGCACAAGCGAGAGC
GCCACACCTGAAAGTTCTGGCGGTTCTTCTGGCGGCAGCAGCGAGGTCGAGTTCTCTCACGA
ATATTGGATGAGACACGCTCTCACCCTGGCTAAGAGAGCCAGGGACGAAAGAGAGGTGCCAG
TTGGCGCTGTCCTGGTGTTGAACAATCGCGTCATCGGAGAAGGATGGAATCGCGCCATTGGC
CTGCACGATCCAACCGCACATGCCGAAATTATGGCTCTGCGGCAAGGCGGCCTCGTGATGCA
AAATTACAGACTGATCGATGCTACCCTCTACGTCACCTTCGAGCCCTGTGTCATGTGTGCTG
GGGCAATGATTCACTCCCGGATTGGCCGCGTGGTGTTTGGAGTGCGGAATGCCAAGACTGGC
GCCGCTGGATCTCTGATGGACGTCCTGCACTATCCTGGGATGAACCACCGGGTCGAGATCAC
AGAGGGAATTCTGGCTGACGAGTGCGCTGCCCTGCTGTGCTACTTCTTTAGAATGCCCAGAC
AGGTGTTCAACGCCCAGAAAAAAGCTCAGAGCAGCACCGATTCCGGCGGAAGCAGCGGAGGA
TCTTCTGGAAGCGAAACCCCAGGCACCAGCGAGTCTGCCACACCAGAATCATCTGGCGGTAG
CTCCGGCGGCAGCGACAAGAAGTATTCTATCGGACTGGCCATCGGCACCAACTCTGTTGGAT
GGGCCGTGATCACCGACGAGTACAAGGTGCCCAGCAAGAAATTCAAGGTGCTGGGCAACACC
GACAGGCACAGCATCAAGAAGAACCTGATCGGCGCACTGCTGTTCGACTCTGGCGAAACAGC
CGAGGCCACCAGACTGAAGAGAACAGCCCGCAGACGGTACACCAGAAGAAAGAACCGGATCT
GCTACCTCCAAGAGATCTTCAGCAACGAGATGGCCAAGGTGGACGACAGCTTCTTCCACAGA
CTGGAAGAGTCCTTCCTGGTGGAAGAGGACAAGAAGCACGAGAGACACCCCATCTTCGGCAA
CATCGTGGACGAGGTGGCCTACCACGAGAAGTACCCCACCATCTACCACCTGAGAAAGAAAC
TGGTGGACAGCACCGACAAGGCCGACCTGAGACTGATCTATCTGGCCCTGGCTCACATGATC
AAGTTCCGGGGCCACTTCCTGATCGAGGGCGACCTGAATCCTGACAACAGCGACGTGGACAA
GCTGTTCATCCAGCTGGTGCAGACCTACAACCAGCTGTTCGAGGAAAACCCCATCAACGCCA
GCGGAGTGGATGCCAAGGCCATCCTGTCTGCCAGACTGAGCAAGAGCAGACGGCTGGAAAAT
CTGATCGCCCAGCTGCCTGGCGAGAAGAAGAATGGCCTGTTCGGCAACCTGATTGCCCTGAG
CCTGGGCCTGACACCTAACTTCAAGAGCAACTTCGACCTGGCCGAGGACGCCAAACTGCAGC
TGAGCAAGGACACCTACGACGACGACCTGGACAATCTGCTGGCCCAGATCGGCGATCAGTAC
GCCGACTTGTTTCTGGCCGCCAAGAATCTGAGCGACGCCATCCTGCTGTCCGACATCCTGAG
AGTGAACACCGAGATCTGCCTGAGCTACGATACCGAGATCCTGACCGTGGAATACGGCTTCC
TGCCTATCGGCAAGATCGTCGAGGAACGGATCGAGTGCACAGTGTACACCGTGGATAAGAAT
GGCTTCGTGTACACCCAGCCTATCGCTCAGTGGCACAACAGAGGCGAGCAAGAGGTGTTCGA
GTACTGCCTGGAAGATGGCAGCATCATCCGGGCCACCAAGGACCACAAGTTTATGACCACCG
ACGGCCAGATGCTGCCCATCGACGAGATCTTTGAGAGGCCTGGACCTGAAACAGGTGGAC
GGACTGCCTTGA
ABE7.10_Cfa-N_Split_S355C:
                                               (SEQ ID NO: 132)
ATGAGCGAGGTGGAATTCAGCCACGAGTACTGGATGCGGCACGCCCTGACACTGGCCAAAAG
AGCTTGGGACGAGAGGGAAGTGCCTGTGGGAGCTGTGCTGGTGCACAACAACAGAGTGATCG
GCGAAGGCTGGAACAGACCCATCGGCAGACACGATCCTACAGCTCACGCCGAGATCATGGCC
CTGAGACAAGGCGGACTGGTCATGCAGAACTACCGGCTGATCGACGCCACACTGTACGTGAC
CCTGGAACCTTGCGTGATGTGTGCCGGCGCTATGATCCACAGCAGAATCGGCAGAGTGGTGT
TCGGCGCCAGAGATGCCAAAACAGGCGCTGCCGGAAGCCTGATGGATGTGCTGCATCACCCC
GGCATGAACCACAGAGTGGAAATCACCGAGGGCATCCTGGCCGATGAATGTGCCGCTCTGCT
```

-continued

```
GAGCGACTTCTTCCGGATGCGGCGGCAAGAGATCAAGGCCCAGAAGAAGGCCCAGTCCAGCA

CAGATAGCGGCGGATCTAGCGGAGGCAGCTCTGGATCTGAGACACCTGGCACAAGCGAGAGC

GCCACACCTGAAAGTTCTGGCGGTTCTTCTGGCGGCAGCAGCGAGGTCGAGTTCTCTCACGA

ATATTGGATGAGACACGCTCTCACCCTGGCTAAGAGAGCCAGGGACGAAAGAGAGGTGCCAG

TTGGCGCTGTCCTGGTGTTGAACAATCGCGTCATCGGAGAAGGATGGAATCGCGCCATTGGC

CTGCACGATCCAACCGCACATGCCGAAATTATGGCTCTGCGGCAAGGCGGCCTCGTGATGCA

AAATTACAGACTGATCGATGCTACCCTCTACGTCACCTTCGAGCCCTGTGTCATGTGTGCTG

GGGCAATGATTCACTCCCGGATTGGCCGCGTGGTGTTTGGAGTGCGGAATGCCAAGACTGGC

GCCGCTGGATCTCTGATGGACGTCCTGCACTATCCTGGGATGAACCACCGGGTCGAGATCAC

AGAGGGAATTCTGGCTGACGAGTGCGCTGCCCTGCTGTGCTACTTCTTTAGAATGCCCAGAC

AGGTGTTCAACGCCCAGAAAAAGCTCAGAGCAGCACCGATTCCGGCGGAAGCAGCGGAGGA

TCTTCTGGAAGCGAAACCCCAGGCACCAGCGAGTCTGCCACACCAGAATCATCTGGCGGTAG

CTCCGGCGGCAGCGACAAGAAGTATTCTATCGGACTGGCCATCGGCACCAACTCTGTTGGAT

GGGCCGTGATCACCGACGAGTACAAGGTGCCCAGCAAGAAATTCAAGGTGCTGGGCAACACC

GACAGGCACAGCATCAAGAAGAACCTGATCGGCGCACTGCTGTTCGACTCTGGCGAAACAGC

CGAGGCCACCAGACTGAAGAGAACAGCCCGCAGACGGTACACCAGAAGAAAGAACCGGATCT

GCTACCTCCAAGAGATCTTCAGCAACGAGATGGCCAAGGTGGACGACAGCTTCTTCCACAGA

CTGGAAGAGTCCTTCCTGGTGGAAGAGGACAAGAAGCACGAGAGACACCCCATCTTCGGCAA

CATCGTGGACGAGGTGGCCTACCACGAGAAGTACCCCACCATCTACCACCTGAGAAAGAAAC

TGGTGGACAGCACCGACAAGGCCGACCTGAGACTGATCTATCTGGCCCTGGCTCACATGATC

AAGTTCCGGGGCCACTTCCTGATCGAGGGCGACCTGAATCCTGACAACAGCGACGTGGACAA

GCTGTTCATCCAGCTGGTGCAGACCTACAACCAGCTGTTCGAGGAAAACCCCATCAACGCCA

GCGGAGTGGATGCCAAGGCCATCCTGTCTGCCAGACTGAGCAAGAGCAGACGGCTGGAAAAT

CTGATCGCCCAGCTGCCTGGCGAGAAGAAGAATGGCCTGTTCGGCAACCTGATTGCCCTGAG

CCTGGGCCTGACACCTAACTTCAAGAGCAACTTCGACCTGGCCGAGGACGCCAAACTGCAGC

TGAGCAAGGACACCTACGACGACGACCTGGACAATCTGCTGGCCCAGATCGGCGATCAGTAC

GCCGACTTGTTTCTGGCCGCCAAGAATCTGAGCGACGCCATCCTGCTGTCCGACATCCTGAG

AGTGAACACCGAGATCACCAAGGCACCTCTGAGCGCCTCTATGATCAAGAGATACGACGAGC

ACCACCAGGATCTGACCCTGCTGAAGGCCCTCGTTAGACAGCAGCTGCCAGAGAAGTACAAA

GAGATTTTCTTCGACCAGTGCCTGAGCTACGATACCGAGATCCTGACCGTGGAATACGGCTT

CCTGCCTATCGGCAAGATCGTCGAGGAACGGATCGAGTGCACAGTGTACACCGTGGATAAGA

ATGGCTTCGTGTACACCCAGCCTATCGCTCAGTGGCACAACAGAGGCGAGCAAGAGGTGTTC

GAGTACTGCCTGGAAGATGGCAGCATCATCCGGGCCACCAAGGACCACAAGTTTATGACCAC

CGACGGCCAGATGCTGCCCATCGACGAGATCTTTGAGAGGCCTGGACCTGAAACAGGTGG

ACGGACTGCCTTGA
```

ABE7.10_Cfa-N_Split_A456C:
(SEQ ID NO: 133)
```
ATGAGCGAGGTGGAATTCAGCCACGAGTACTGGATGCGGCACGCCCTGACACTGGCCAAAAG

AGCTTGGGACGAGAGGGAAGTGCCTGTGGGAGCTGTGCTGGTGCACAACAACAGAGTGATCG

GCGAAGGCTGGAACAGACCCATCGGCAGACACGATCCTACAGCTCACGCCGAGATCATGGCC

CTGAGACAAGGCGGACTGGTCATGCAGAACTACCGGCTGATCGACGCCACACTGTACGTGAC
```

-continued

```
CCTGGAACCTTGCGTGATGTGTGCCGGCGCTATGATCCACAGCAGAATCGGCAGAGTGGTGT
TCGGCGCCAGAGATGCCAAAACAGGCGCTGCCGGAAGCCTGATGGATGTGCTGCATCACCCC
GGCATGAACCACAGAGTGGAAATCACCGAGGGCATCCTGGCCGATGAATGTGCCGCTCTGCT
GAGCGACTTCTTCCGGATGCGGCGGCAAGAGATCAAGGCCCAGAAGAAGGCCCAGTCCAGCA
CAGATAGCGGCGGATCTAGCGGAGGCAGCTCTGGATCTGAGACACCTGGCACAAGCGAGAGC
GCCACACCTGAAAGTTCTGGCGGTTCTTCTGGCGGCAGCAGCGAGGTCGAGTTCTCTCACGA
ATATTGGATGAGACACGCTCTCACCCTGGCTAAGAGAGCCAGGGACGAAAGAGAGGTGCCAG
TTGGCGCTGTCCTGGTGTTGAACAATCGCGTCATCGGAGAAGGATGGAATCGCGCCATTGGC
CTGCACGATCCAACCGCACATGCCGAAATTATGGCTCTGCGGCAAGGCGGCCTCGTGATGCA
AAATTACAGACTGATCGATGCTACCCTCTACGTCACCTTCGAGCCCTGTGTCATGTGTGCTG
GGGCAATGATTCACTCCCGGATTGGCCGCGTGGTGTTTGGAGTGCGGAATGCCAAGACTGGC
GCCGCTGGATCTCTGATGGACGTCCTGCACTATCCTGGGATGAACCACCGGGTCGAGATCAC
AGAGGGAATTCTGGCTGACGAGTGCGCTGCCCTGCTGTGCTACTTCTTTAGAATGCCCAGAC
AGGTGTTCAACGCCCAGAAAAAAGCTCAGAGCAGCACCGATTCCGGCGGAAGCAGCGGAGGA
TCTTCTGGAAGCGAAACCCCAGGCACCAGCGAGTCTGCCACACCAGAATCATCTGGCGGTAG
CTCCGGCGGCAGCGACAAGAAGTATTCTATCGGACTGGCCATCGGCACCAACTCTGTTGGAT
GGGCCGTGATCACCGACGAGTACAAGGTGCCCAGCAAGAAATTCAAGGTGCTGGGCAACACC
GACAGGCACAGCATCAAGAAGAACCTGATCGGCGCACTGCTGTTCGACTCTGGCGAAACAGC
CGAGGCCACCAGACTGAAGAGAACAGCCCGCAGACGGTACACCAGAAGAAAGAACCGGATCT
GCTACCTCCAAGAGATCTTCAGCAACGAGATGGCCAAGGTGGACGACAGCTTCTTCCACAGA
CTGGAAGAGTCCTTCCTGGTGGAAGAGGACAAGAAGCACGAGAGACACCCCATCTTCGGCAA
CATCGTGGACGAGGTGGCCTACCACGAGAAGTACCCCACCATCTACCACCTGAGAAAGAAAC
TGGTGGACAGCACCGACAAGGCCGACCTGAGACTGATCTATCTGGCCCTGGCTCACATGATC
AAGTTCCGGGGCCACTTCCTGATCGAGGGCGACCTGAATCCTGACAACAGCGACGTGGACAA
GCTGTTCATCCAGCTGGTGCAGACCTACAACCAGCTGTTCGAGGAAAACCCCATCAACGCCA
GCGGAGTGGATGCCAAGGCCATCCTGTCTGCCAGACTGAGCAAGAGCAGACGGCTGGAAAAT
CTGATCGCCCAGCTGCCTGGCGAGAAGAAGAATGGCCTGTTCGGCAACCTGATTGCCCTGAG
CCTGGGCCTGACACCTAACTTCAAGAGCAACTTCGACCTGGCCGAGGACGCCAAACTGCAGC
TGAGCAAGGACACCTACGACGACGACCTGGACAATCTGCTGGCCCAGATCGGCGATCAGTAC
GCCGACTTGTTTCTGGCCGCCAAGAATCTGAGCGACGCCATCCTGCTGTCCGACATCCTGAG
AGTGAACACCGAGATCACCAAGGCACCTCTGAGCGCCTCTATGATCAAGAGATACGACGAGC
ACCACCAGGATCTGACCCTGCTGAAGGCCCTCGTTAGACAGCAGCTGCCAGAGAAGTACAAA
GAGATTTTCTTCGACCAGAGCAAGAACGGCTACGCCGGCTACATTGATGGCGGAGCCAGCCA
AGAGGAATTCTACAAGTTCATCAAGCCCATCCTCGAGAAGATGGACGGCACCGAGGAACTGC
TGGTCAAGCTGAACAGAGAGGACCTGCTGAGAAAGCAGAGAACCTTCGACAACGGCAGCATC
CCTCACCAGATCCACCTGGGAGAACTGCACGCCATTCTGCGGAGACAAGAGGACTTTTACCC
ATTCCTGAAGGACAACCGGGAAAAGATCGAGAAAATCCTGACCTTCAGGATCCCCTACTACG
TGGGACCACTGTGCCTGAGCTACGATACCGAGATCCTGACCGTGGAATACGGCTTCCTGCCT
ATCGGCAAGATCGTCGAGGAACGGATCGAGTGCACAGTGTACACCGTGGATAAGAATGGCTT
CGTGTACACCCAGCCTATCGCTCAGTGGCACAACAGAGGCGAGCAAGAGGTGTTCGAGTACT
GCCTGGAAGATGGCAGCATCATCCGGGCCACCAAGGACCACAAGTTTATGACCACCGACGGC
```

-continued

CAGATGCTGCCCATCGACGAGATCTTTGAGAGAGGCCTGGACCTGAAACAGGTGGACGGACT

GCCTTGA

ABE7.10_Cfa-N_Split_S460C:
(SEQ ID NO: 134)
ATGAGCGAGGTGGAATTCAGCCACGAGTACTGGATGCGGCACGCCCTGACACTGGCCAAAAG

AGCTTGGGACGAGAGGGAAGTGCCTGTGGGAGCTGTGCTGGTGCACAACAACAGAGTGATCG

GCGAAGGCTGGAACAGACCCATCGGCAGACACGATCCTACAGCTCACGCCGAGATCATGGCC

CTGAGACAAGGCGGACTGGTCATGCAGAACTACCGGCTGATCGACGCCACACTGTACGTGAC

CCTGGAACCTTGCGTGATGTGTGCCGGCGCTATGATCCACAGCAGAATCGGCAGAGTGGTGT

TCGGCGCCAGAGATGCCAAAACAGGCGCTGCCGGAAGCCTGATGGATGTGCTGCATCACCCC

GGCATGAACCACAGAGTGGAAATCACCGAGGGCATCCTGGCCGATGAATGTGCCGCTCTGCT

GAGCGACTTCTTCCGGATGCGGCGGCAAGAGATCAAGGCCCAGAAGAAGGCCCAGTCCAGCA

CAGATAGCGGCGGATCTAGCGGAGGCAGCTCTGGATCTGAGACACCTGGCACAAGCGAGAGC

GCCACACCTGAAAGTTCTGGCGGTTCTTCTGGCGGCAGCAGCGAGGTCGAGTTCTCTCACGA

ATATTGGATGAGACACGCTCTCACCCTGGCTAAGAGAGCCAGGGACGAAAGAGAGGTGCCAG

TTGGCGCTGTCCTGGTGTTGAACAATCGCGTCATCGGAGAAGGATGGAATCGCGCCATTGGC

CTGCACGATCCAACCGCACATGCCGAAATTATGGCTCTGCGGCAAGGCGGCCTCGTGATGCA

AAATTACAGACTGATCGATGCTACCCTCTACGTCACCTTCGAGCCCTGTGTCATGTGTGCTG

GGGCAATGATTCACTCCCGGATTGGCCGCGTGGTGTTTGGAGTGCGGAATGCCAAGACTGGC

GCCGCTGGATCTCTGATGGACGTCCTGCACTATCCTGGGATGAACCACCGGGTCGAGATCAC

AGAGGGAATTCTGGCTGACGAGTGCGCTGCCCTGCTGTGCTACTTCTTTAGAATGCCCAGAC

AGGTGTTCAACGCCCAGAAAAAAGCTCAGAGCAGCACCGATTCCGGCGGAAGCAGCGGAGGA

TCTTCTGGAAGCGAAACCCCAGGCACCAGCGAGTCTGCCACACCAGAATCATCTGGCGGTAG

CTCCGGCGGCAGCGACAAGAAGTATTCTATCGGACTGGCCATCGGCACCAACTCTGTTGGAT

GGGCCGTGATCACCGACGAGTACAAGGTGCCCAGCAAGAAATTCAAGGTGCTGGGCAACACC

GACAGGCACAGCATCAAGAAGAACCTGATCGGCGCACTGCTGTTCGACTCTGGCGAAACAGC

CGAGGCCACCAGACTGAAGAGAACAGCCCGCAGACGGTACACCAGAAGAAAGAACCGGATCT

GCTACCTCCAAGAGATCTTCAGCAACGAGATGGCCAAGGTGGACGACAGCTTCTTCCACAGA

CTGGAAGAGTCCTTCCTGGTGGAAGAGGACAAGAAGCACGAGAGACACCCCATCTTCGGCAA

CATCGTGGACGAGGTGGCCTACCACGAGAAGTACCCCACCATCTACCACCTGAGAAAGAAAC

TGGTGGACAGCACCGACAAGGCCGACCTGAGACTGATCTATCTGGCCCTGGCTCACATGATC

AAGTTCCGGGGCCACTTCCTGATCGAGGGCGACCTGAATCCTGACAACAGCGACGTGGACAA

GCTGTTCATCCAGCTGGTGCAGACCTACAACCAGCTGTTCGAGGAAAACCCCATCAACGCCA

GCGGAGTGGATGCCAAGGCCATCCTGTCTGCCAGACTGAGCAAGAGCAGACGGCTGGAAAAT

CTGATCGCCCAGCTGCCTGGCGAGAAGAAGAATGGCCTGTTCGGCAACCTGATTGCCCTGAG

CCTGGGCCTGACACCTAACTTCAAGAGCAACTTCGACCTGGCCGAGGACGCCAAACTGCAGC

TGAGCAAGGACACCTACGACGACGACCTGGACAATCTGCTGGCCCAGATCGGCGATCAGTAC

GCCGACTTGTTTCTGGCCGCCAAGAATCTGAGCGACGCCATCCTGCTGTCCGACATCCTGAG

AGTGAACACCGAGATCACCAAGGCACCTCTGAGCGCCTCTATGATCAAGAGATACGACGAGC

ACCACCAGGATCTGACCCTGCTGAAGGCCCTCGTTAGACAGCAGCTGCCAGAGAAGTACAAA

GAGATTTTCTTCGACCAGAGCAAGAACGGCTACGCCGGCTACATTGATGGCGGAGCCAGCCA

-continued

AGAGGAATTCTACAAGTTCATCAAGCCCATCCTCGAGAAGATGGACGGCACCGAGGAACTGC

TGGTCAAGCTGAACAGAGAGGACCTGCTGAGAAAGCAGAGAACCTTCGACAACGGCAGCATC

CCTCACCAGATCCACCTGGGAGAACTGCACGCCATTCTGCGGAGACAAGAGGACTTTTACCC

ATTCCTGAAGGACAACCGGGAAAAGATCGAGAAAATCCTGACCTTCAGGATCCCCTACTACG

TGGGACCACTGGCCAGAGGCAATTGCCTGAGCTACGATACCGAGATCCTGACCGTGGAATAC

GGCTTCCTGCCTATCGGCAAGATCGTCGAGGAACGGATCGAGTGCACAGTGTACACCGTGGA

TAAGAATGGCTTCGTGTACACCCAGCCTATCGCTCAGTGGCACAACAGAGGCGAGCAAGAGG

TGTTCGAGTACTGCCTGGAAGATGGCAGCATCATCCGGGCCACCAAGGACCACAAGTTTATG

ACCACCGACGGCCAGATGCTGCCCATCGACGAGATCTTTGAGAGAGGCCTGGACCTGAAACA

GGTGGACGGACTGCCTTGA

ABE7.10_Cfa-N_Split_A463C:

(SEQ ID NO: 135)

ATGAGCGAGGTGGAATTCAGCCACGAGTACTGGATGCGGCACGCCCTGACACTGGCCAAAAG

AGCTTGGGACGAGAGGGAAGTGCCTGTGGGAGCTGTGCTGGTGCACAACAACAGAGTGATCG

GCGAAGGCTGGAACAGACCCATCGGCAGACACGATCCTACAGCTCACGCCGAGATCATGGCC

CTGAGACAAGGCGGACTGGTCATGCAGAACTACCGGCTGATCGACGCCACACTGTACGTGAC

CCTGGAACCTTGCGTGATGTGTGCCGGCGCTATGATCCACAGCAGAATCGGCAGAGTGGTGT

TCGGCGCCAGAGATGCCAAAACAGGCGCTGCCGGAAGCCTGATGGATGTGCTGCATCACCCC

GGCATGAACCACAGAGTGGAAATCACCGAGGGCATCCTGGCCGATGAATGTGCCGCTCTGCT

GAGCGACTTCTTCCGGATGCGGCGGCAAGAGATCAAGGCCCAGAAGAAGGCCCAGTCCAGCA

CAGATAGCGGCGGATCTAGCGGAGGCAGCTCTGGATCTGAGACACCTGGCACAAGCGAGAGC

GCCACACCTGAAAGTTCTGGCGGTTCTTCTGGCGGCAGCAGCGAGGTCGAGTTCTCTCACGA

ATATTGGATGAGACACGCTCTCACCCTGGCTAAGAGAGCCAGGGACGAAAGAGAGGTGCCAG

TTGGCGCTGTCCTGGTGTTGAACAATCGCGTCATCGGAGAAGGATGGAATCGCGCCATTGGC

CTGCACGATCCAACCGCACATGCCGAAATTATGGCTCTGCGGCAAGGCGGCCTCGTGATGCA

AAATTACAGACTGATCGATGCTACCCTCTACGTCACCTTCGAGCCCTGTGTCATGTGTGCTG

GGGCAATGATTCACTCCCGGATTGGCCGCGTGGTGTTTGGAGTGCGGAATGCCAAGACTGGC

GCCGCTGGATCTCTGATGGACGTCCTGCACTATCCTGGGATGAACCACCGGGTCGAGATCAC

AGAGGGAATTCTGGCTGACGAGTGCGCTGCCCTGCTGTGCTACTTCTTTAGAATGCCCAGAC

AGGTGTTCAACGCCCAGAAAAAAGCTCAGAGCAGCACCGATTCCGGCGGAAGCAGCGGAGGA

TCTTCTGGAAGCGAAACCCCAGGCACCAGCGAGTCTGCCACACCAGAATCATCTGGCGGTAG

CTCCGGCGGCAGCGACAAGAAGTATTCTATCGGACTGGCCATCGGCACCAACTCTGTTGGAT

GGGCCGTGATCACCGACGAGTACAAGGTGCCCAGCAAGAAATTCAAGGTGCTGGGCAACACC

GACAGGCACAGCATCAAGAAGAACCTGATCGGCGCACTGCTGTTCGACTCTGGCGAAACAGC

CGAGGCCACCAGACTGAAGAGAACAGCCCGCAGACGGTACACCAGAAGAAAGAACCGGATCT

GCTACCTCCAAGAGATCTTCAGCAACGAGATGGCCAAGGTGGACGACAGCTTCTTCCACAGA

CTGGAAGAGTCCTTCCTGGTGGAAGAGGACAAGAAGCACGAGAGACACCCCATCTTCGGCAA

CATCGTGGACGAGGTGGCCTACCACGAGAAGTACCCCACCATCTACCACCTGAGAAAGAAAC

TGGTGGACAGCACCGACAAGGCCGACCTGAGACTGATCTATCTGGCCCTGGCTCACATGATC

AAGTTCCGGGGCCACTTCCTGATCGAGGGCGACCTGAATCCTGACAACAGCGACGTGGACAA

GCTGTTCATCCAGCTGGTGCAGACCTACAACCAGCTGTTCGAGGAAAACCCCATCAACGCCA

GCGGAGTGGATGCCAAGGCCATCCTGTCTGCCAGACTGAGCAAGAGCAGACGGCTGGAAAAT

-continued

CTGATCGCCCAGCTGCCTGGCGAGAAGAAGAATGGCCTGTTCGGCAACCTGATTGCCCTGAG

CCTGGGCCTGACACCTAACTTCAAGAGCAACTTCGACCTGGCCGAGGACGCCAAACTGCAGC

TGAGCAAGGACACCTACGACGACGACCTGGACAATCTGCTGGCCCAGATCGGCGATCAGTAC

GCCGACTTGTTTCTGGCCGCCAAGAATCTGAGCGACGCCATCCTGCTGTCCGACATCCTGAG

AGTGAACACCGAGATCACCAAGGCACCTCTGAGCGCCTCTATGATCAAGAGATACGACGAGC

ACCACCAGGATCTGACCCTGCTGAAGGCCCTCGTTAGACAGCAGCTGCCAGAGAAGTACAAA

GAGATTTTCTTCGACCAGAGCAAGAACGGCTACGCCGGCTACATTGATGGCGGAGCCAGCCA

AGAGGAATTCTACAAGTTCATCAAGCCCATCCTCGAGAAGATGGACGGCACCGAGGAACTGC

TGGTCAAGCTGAACAGAGAGGACCTGCTGAGAAAGCAGAGAACCTTCGACAACGGCAGCATC

CCTCACCAGATCCACCTGGGAGAACTGCACGCCATTCTGCGGAGACAAGAGGACTTTTACCC

ATTCCTGAAGGACAACCGGGAAAAGATCGAGAAAATCCTGACCTTCAGGATCCCCTACTACG

TGGGACCACTGGCCAGAGGCAATAGCAGATTCTGCCTGAGCTACGATACCGAGATCCTGACC

GTGGAATACGGCTTCCTGCCTATCGGCAAGATCGTCGAGGAACGGATCGAGTGCACAGTGTA

CACCGTGGATAAGAATGGCTTCGTGTACACCCAGCCTATCGCTCAGTGGCACAACAGAGGCG

AGCAAGAGGTGTTCGAGTACTGCCTGGAAGATGGCAGCATCATCCGGGCCACCAAGGACCAC

AAGTTTATGACCACCGACGGCCAGATGCTGCCCATCGACGAGATCTTTGAGAGAGGCCTGGA

CCTGAAACAGGTGGACGGACTGCCTTGA

ABE7.10_Cfa-N_Split_T466C:

(SEQ ID NO: 136)

ATGAGCGAGGTGGAATTCAGCCACGAGTACTGGATGCGGCACGCCCTGACACTGGCCAAAAG

AGCTTGGGACGAGAGGGAAGTGCCTGTGGGAGCTGTGCTGGTGCACAACAACAGAGTGATCG

GCGAAGGCTGGAACAGACCCATCGGCAGACACGATCCTACAGCTCACGCCGAGATCATGGCC

CTGAGACAAGGCGGACTGGTCATGCAGAACTACCGGCTGATCGACGCCACACTGTACGTGAC

CCTGGAACCTTGCGTGATGTGTGCCGGCGCTATGATCCACAGCAGAATCGGCAGAGTGGTGT

TCGGCGCCAGAGATGCCAAAACAGGCGCTGCCGGAAGCCTGATGGATGTGCTGCATCACCCC

GGCATGAACCACAGAGTGGAAATCACCGAGGGCATCCTGGCCGATGAATGTGCCGCTCTGCT

GAGCGACTTCTTCCGGATGCGGCGGCAAGAGATCAAGGCCCAGAAGAAGGCCCAGTCCAGCA

CAGATAGCGGCGGATCTAGCGGAGGCAGCTCTGGATCTGAGACACCTGGCACAAGCGAGAGC

GCCACACCTGAAAGTTCTGGCGGTTCTTCTGGCGGCAGCAGCGAGGTCGAGTTCTCTCACGA

ATATTGGATGAGACACGCTCTCACCCTGGCTAAGAGAGCCAGGGACGAAAGAGAGGTGCCAG

TTGGCGCTGTCCTGGTGTTGAACAATCGCGTCATCGGAGAAGGATGGAATCGCGCCATTGGC

CTGCACGATCCAACCGCACATGCCGAAATTATGGCTCTGCGGCAAGGCGGCCTCGTGATGCA

AAATTACAGACTGATCGATGCTACCCTCTACGTCACCTTCGAGCCCTGTGTCATGTGTGCTG

GGGCAATGATTCACTCCCGGATTGGCCGCGTGGTGTTTGGAGTGCGGAATGCCAAGACTGGC

GCCGCTGGATCTCTGATGGACGTCCTGCACTATCCTGGGATGAACCACCGGGTCGAGATCAC

AGAGGGAATTCTGGCTGACGAGTGCGCTGCCCTGCTGTGCTACTTCTTTAGAATGCCCAGAC

AGGTGTTCAACGCCCAGAAAAAAGCTCAGAGCAGCACCGATTCCGGCGGAAGCAGCGGAGGA

TCTTCTGGAAGCGAAACCCCAGGCACCAGCGAGTCTGCCACACCAGAATCATCTGGCGGTAG

CTCCGGCGGCAGCGACAAGAAGTATTCTATCGGACTGGCCATCGGCACCAACTCTGTTGGAT

GGGCCGTGATCACCGACGAGTACAAGGTGCCCAGCAAGAAATTCAAGGTGCTGGGCAACACC

GACAGGCACAGCATCAAGAAGAACCTGATCGGCGCACTGCTGTTCGACTCTGGCGAAACAGC

-continued

```
CGAGGCCACCAGACTGAAGAGAACAGCCCGCAGACGGTACACCAGAAGAAAGAACCGGATCT

GCTACCTCCAAGAGATCTTCAGCAACGAGATGGCCAAGGTGGACGACAGCTTCTTCCACAGA

CTGGAAGAGTCCTTCCTGGTGGAAGAGGACAAGAAGCACGAGAGACACCCCATCTTCGGCAA

CATCGTGGACGAGGTGGCCTACCACGAGAAGTACCCCACCATCTACCACCTGAGAAAGAAAC

TGGTGGACAGCACCGACAAGGCCGACCTGAGACTGATCTATCTGGCCCTGGCTCACATGATC

AAGTTCCGGGGCCACTTCCTGATCGAGGGCGACCTGAATCCTGACAACAGCGACGTGGACAA

GCTGTTCATCCAGCTGGTGCAGACCTACAACCAGCTGTTCGAGGAAAACCCCATCAACGCCA

GCGGAGTGGATGCCAAGGCCATCCTGTCTGCCAGACTGAGCAAGAGCAGACGGCTGGAAAAT

CTGATCGCCCAGCTGCCTGGCGAGAAGAAGAATGGCCTGTTCGGCAACCTGATTGCCCTGAG

CCTGGGCCTGACACCTAACTTCAAGAGCAACTTCGACCTGGCCGAGGACGCCAAACTGCAGC

TGAGCAAGGACACCTACGACGACGACCTGGACAATCTGCTGGCCCAGATCGGCGATCAGTAC

GCCGACTTGTTTCTGGCCGCCAAGAATCTGAGCGACGCCATCCTGCTGTCCGACATCCTGAG

AGTGAACACCGAGATCACCAAGGCACCTCTGAGCGCCTCTATGATCAAGAGATACGACGAGC

ACCACCAGGATCTGACCCTGCTGAAGGCCCTCGTTAGACAGCAGCTGCCAGAGAAGTACAAA

GAGATTTTCTTCGACCAGAGCAAGAACGGCTACGCCGGCTACATTGATGGCGGAGCCAGCCA

AGAGGAATTCTACAAGTTCATCAAGCCCATCCTCGAGAAGATGGACGGCACCGAGGAACTGC

TGGTCAAGCTGAACAGAGAGGACCTGCTGAGAAAGCAGAGAACCTTCGACAACGGCAGCATC

CCTCACCAGATCCACCTGGGAGAACTGCACGCCATTCTGCGGAGACAAGAGGACTTTTACCC

ATTCCTGAAGGACAACCGGGAAAAGATCGAGAAAATCCTGACCTTCAGGATCCCCTACTACG

TGGGACCACTGGCCAGAGGCAATAGCAGATTCGCCTGGATGTGCCTGAGCTACGATACCGAG

ATCCTGACCGTGGAATACGGCTTCCTGCCTATCGGCAAGATCGTCGAGGAACGGATCGAGTG

CACAGTGTACACCGTGGATAAGAATGGCTTCGTGTACACCCAGCCTATCGCTCAGTGGCACA

ACAGAGGCGAGCAAGAGGTGTTCGAGTACTGCCTGGAAGATGGCAGCATCATCCGGGCCACC

AAGGACCACAAGTTTATGACCACCGACGGCCAGATGCTGCCCATCGACGAGATCTTTGAGAG

AGGCCTGGACCTGAAACAGGTGGACGGACTGCCTTGA
```

ABE7.10_Cfa-N_Split_S469C:

(SEQ ID NO: 137)

```
ATGAGCGAGGTGGAATTCAGCCACGAGTACTGGATGCGGCACGCCCTGACACTGGCCAAAAG

AGCTTGGGACGAGAGGGAAGTGCCTGTGGGAGCTGTGCTGGTGCACAACAACAGAGTGATCG

GCGAAGGCTGGAACAGACCCATCGGCAGACACGATCCTACAGCTCACGCCGAGATCATGGCC

CTGAGACAAGGCGGACTGGTCATGCAGAACTACCGGCTGATCGACGCCACACTGTACGTGAC

CCTGGAACCTTGCGTGATGTGTGCCGGCGCTATGATCCACAGCAGAATCGGCAGAGTGGTGT

TCGGCGCCAGAGATGCCAAAACAGGCGCTGCCGGAAGCCTGATGGATGTGCTGCATCACCCC

GGCATGAACCACAGAGTGGAAATCACCGAGGGCATCCTGGCCGATGAATGTGCCGCTCTGCT

GAGCGACTTCTTCCGGATGCGGCGGCAAGAGATCAAGGCCCAGAAGAAGGCCCAGTCCAGCA

CAGATAGCGGCGGATCTAGCGGAGGCAGCTCTGGATCTGAGACACCTGGCACAAGCGAGAGC

GCCACACCTGAAAGTTCTGGCGGTTCTTCTGGCGGCAGCAGCGAGGTCGAGTTCTCTCACGA

ATATTGGATGAGACACGCTCTCACCCTGGCTAAGAGAGCCAGGGACGAAAGAGAGGTGCCAG

TTGGCGCTGTCCTGGTGTTGAACAATCGCGTCATCGGAGAAGGATGGAATCGCGCCATTGGC

CTGCACGATCCAACCGCACATGCCGAAATTATGGCTCTGCGGCAAGGCGGCCTCGTGATGCA

AAATTACAGACTGATCGATGCTACCCTCTACGTCACCTTCGAGCCCTGTGTCATGTGTGCTG

GGGCAATGATTCACTCCCGGATTGGCCGCGTGGTGTTTGGAGTGCGGAATGCCAAGACTGGC
```

-continued

```
GCCGCTGGATCTCTGATGGACGTCCTGCACTATCCTGGGATGAACCACCGGGTCGAGATCAC
AGAGGGAATTCTGGCTGACGAGTGCGCTGCCCTGCTGTGCTACTTCTTTAGAATGCCCAGAC
AGGTGTTCAACGCCCAGAAAAAAGCTCAGAGCAGCACCGATTCCGGCGGAAGCAGCGGAGGA
TCTTCTGGAAGCGAAACCCCAGGCACCAGCGAGTCTGCCACACCAGAATCATCTGGCGGTAG
CTCCGGCGGCAGCGACAAGAAGTATTCTATCGGACTGGCCATCGGCACCAACTCTGTTGGAT
GGGCCGTGATCACCGACGAGTACAAGGTGCCCAGCAAGAAATTCAAGGTGCTGGGCAACACC
GACAGGCACAGCATCAAGAAGAACCTGATCGGCGCACTGCTGTTCGACTCTGGCGAAACAGC
CGAGGCCACCAGACTGAAGAGAACAGCCCGCAGACGGTACACCAGAAGAAAGAACCGGATCT
GCTACCTCCAAGAGATCTTCAGCAACGAGATGGCCAAGGTGGACGACAGCTTCTTCCACAGA
CTGGAAGAGTCCTTCCTGGTGGAAGAGGACAAGAAGCACGAGAGACACCCCATCTTCGGCAA
CATCGTGGACGAGGTGGCCTACCACGAGAAGTACCCCACCATCTACCACCTGAGAAAGAAAC
TGGTGGACAGCACCGACAAGGCCGACCTGAGACTGATCTATCTGGCCCTGGCTCACATGATC
AAGTTCCGGGGCCACTTCCTGATCGAGGGCGACCTGAATCCTGACAACAGCGACGTGGACAA
GCTGTTCATCCAGCTGGTGCAGACCTACAACCAGCTGTTCGAGGAAAACCCCATCAACGCCA
GCGGAGTGGATGCCAAGGCCATCCTGTCTGCCAGACTGAGCAAGAGCAGACGGCTGGAAAAT
CTGATCGCCCAGCTGCCTGGCGAGAAGAAGAATGGCCTGTTCGGCAACCTGATTGCCCTGAG
CCTGGGCCTGACACCTAACTTCAAGAGCAACTTCGACCTGGCCGAGGACGCCAAACTGCAGC
TGAGCAAGGACACCTACGACGACGACCTGGACAATCTGCTGGCCCAGATCGGCGATCAGTAC
GCCGACTTGTTTCTGGCCGCCAAGAATCTGAGCGACGCCATCCTGCTGTCCGACATCCTGAG
AGTGAACACCGAGATCACCAAGGCACCTCTGAGCGCCTCTATGATCAAGAGATACGACGAGC
ACCACCAGGATCTGACCCTGCTGAAGGCCCTCGTTAGACAGCAGCTGCCAGAGAAGTACAAA
GAGATTTTCTTCGACCAGAGCAAGAACGGCTACGCCGGCTACATTGATGGCGGAGCCAGCCA
AGAGGAATTCTACAAGTTCATCAAGCCCATCCTCGAGAAGATGGACGGCACCGAGGAACTGC
TGGTCAAGCTGAACAGAGAGGACCTGCTGAGAAAGCAGAGAACCTTCGACAACGGCAGCATC
CCTCACCAGATCCACCTGGGAGAACTGCACGCCATTCTGCGGAGACAAGAGGACTTTTACCC
ATTCCTGAAGGACAACCGGGAAAAGATCGAGAAAATCCTGACCTTCAGGATCCCCTACTACG
TGGGACCACTGGCCAGAGGCAATAGCAGATTCGCCTGGATGACCAGAAAGTGCCTGAGCTAC
GATACCGAGATCCTGACCGTGGAATACGGCTTCCTGCCTATCGGCAAGATCGTCGAGGAACG
GATCGAGTGCACAGTGTACACCGTGGATAAGAATGGCTTCGTGTACACCCAGCCTATCGCTC
AGTGGCACAACAGAGGCGAGCAAGAGGTGTTCGAGTACTGCCTGGAAGATGGCAGCATCATC
CGGGCCACCAAGGACCACAAGTTTATGACCACCGACGGCCAGATGCTGCCCATCGACGAGAT
CTTTGAGAGAGGCCTGGACCTGAAACAGGTGGACGGACTGCCTTGA
ABE7.10_Cfa-N_Split_T472C:
                                                        (SEQ ID NO: 138)
ATGAGCGAGGTGGAATTCAGCCACGAGTACTGGATGCGGCACGCCCTGACACTGGCCAAAAG
AGCTTGGGACGAGAGGGAAGTGCCTGTGGGAGCTGTGCTGGTGCACAACAACAGAGTGATCG
GCGAAGGCTGGAACAGACCCATCGGCAGACACGATCCTACAGCTCACGCCGAGATCATGGCC
CTGAGACAAGGCGGACTGGTCATGCAGAACTACCGGCTGATCGACGCCACACTGTACGTGAC
CCTGGAACCTTGCGTGATGTGTGCCGGCGCTATGATCCACAGCAGAATCGGCAGAGTGGTGT
TCGGCGCCAGAGATGCCAAAACAGGCGCTGCCGGAAGCCTGATGGATGTGCTGCATCACCCC
GGCATGAACCACAGAGTGGAAATCACCGAGGGCATCCTGGCCGATGAATGTGCCGCTCTGCT
```

-continued

```
GAGCGACTTCTTCCGGATGCGGCGGCAAGAGATCAAGGCCCAGAAGAAGGCCCAGTCCAGCA

CAGATAGCGGCGGATCTAGCGGAGGCAGCTCTGGATCTGAGACACCTGGCACAAGCGAGAGC

GCCACACCTGAAAGTTCTGGCGGTTCTTCTGGCGGCAGCAGCGAGGTCGAGTTCTCTCACGA

ATATTGGATGAGACACGCTCTCACCCTGGCTAAGAGAGCCAGGGACGAAAGAGAGGTGCCAG

TTGGCGCTGTCCTGGTGTTGAACAATCGCGTCATCGGAGAAGGATGGAATCGCGCCATTGGC

CTGCACGATCCAACCGCACATGCCGAAATTATGGCTCTGCGGCAAGGCGGCCTCGTGATGCA

AAATTACAGACTGATCGATGCTACCCTCTACGTCACCTTCGAGCCCTGTGTCATGTGTGCTG

GGGCAATGATTCACTCCCGGATTGGCCGCGTGGTGTTTGGAGTGCGGAATGCCAAGACTGGC

GCCGCTGGATCTCTGATGGACGTCCTGCACTATCCTGGGATGAACCACCGGGTCGAGATCAC

AGAGGGAATTCTGGCTGACGAGTGCGCTGCCCTGCTGTGCTACTTCTTTAGAATGCCCAGAC

AGGTGTTCAACGCCCAGAAAAAAGCTCAGAGCAGCACCGATTCCGGCGGAAGCAGCGGAGGA

TCTTCTGGAAGCGAAACCCCAGGCACCAGCGAGTCTGCCACACCAGAATCATCTGGCGGTAG

CTCCGGCGGCAGCGACAAGAAGTATTCTATCGGACTGGCCATCGGCACCAACTCTGTTGGAT

GGGCCGTGATCACCGACGAGTACAAGGTGCCCAGCAAGAAATTCAAGGTGCTGGGCAACACC

GACAGGCACAGCATCAAGAAGAACCTGATCGGCGCACTGCTGTTCGACTCTGGCGAAACAGC

CGAGGCCACCAGACTGAAGAGAACAGCCCGCAGACGGTACACCAGAAGAAAGAACCGGATCT

GCTACCTCCAAGAGATCTTCAGCAACGAGATGGCCAAGGTGGACGACAGCTTCTTCCACAGA

CTGGAAGAGTCCTTCCTGGTGGAAGAGGACAAGAAGCACGAGAGACACCCCATCTTCGGCAA

CATCGTGGACGAGGTGGCCTACCACGAGAAGTACCCCACCATCTACCACCTGAGAAAGAAAC

TGGTGGACAGCACCGACAAGGCCGACCTGAGACTGATCTATCTGGCCCTGGCTCACATGATC

AAGTTCCGGGGCCACTTCCTGATCGAGGGCGACCTGAATCCTGACAACAGCGACGTGGACAA

GCTGTTCATCCAGCTGGTGCAGACCTACAACCAGCTGTTCGAGGAAAACCCCATCAACGCCA

GCGGAGTGGATGCCAAGGCCATCCTGTCTGCCAGACTGAGCAAGAGCAGACGGCTGGAAAAT

CTGATCGCCCAGCTGCCTGGCGAGAAGAAGAATGGCCTGTTCGGCAACCTGATTGCCCTGAG

CCTGGGCCTGACACCTAACTTCAAGAGCAACTTCGACCTGGCCGAGGACGCCAAACTGCAGC

TGAGCAAGGACACCTACGACGACGACCTGGACAATCTGCTGGCCCAGATCGGCGATCAGTAC

GCCGACTTGTTTCTGGCCGCCAAGAATCTGAGCGACGCCATCCTGCTGTCCGACATCCTGAG

AGTGAACACCGAGATCACCAAGGCACCTCTGAGCGCCTCTATGATCAAGAGATACGACGAGC

ACCACCAGGATCTGACCCTGCTGAAGGCCCTCGTTAGACAGCAGCTGCCAGAGAAGTACAAA

GAGATTTTCTTCGACCAGAGCAAGAACGGCTACGCCGGCTACATTGATGGCGGAGCCAGCCA

AGAGGAATTCTACAAGTTCATCAAGCCCATCCTCGAGAAGATGGACGGCACCGAGGAACTGC

TGGTCAAGCTGAACAGAGAGGACCTGCTGAGAAAGCAGAGAACCTTCGACAACGGCAGCATC

CCTCACCAGATCCACCTGGGAGAACTGCACGCCATTCTGCGGAGACAAGAGGACTTTTACCC

ATTCCTGAAGGACAACCGGGAAAAGATCGAGAAAATCCTGACCTTCAGGATCCCCTACTACG

TGGGACCACTGGCCAGAGGCAATAGCAGATTCGCCTGGATGACCAGAAAGAGCGAGGAATGC

CTGAGCTACGATACCGAGATCCTGACCGTGGAATACGGCTTCCTGCCTATCGGCAAGATCGT

CGAGGAACGGATCGAGTGCACAGTGTACACCGTGGATAAGAATGGCTTCGTGTACACCCAGC

CTATCGCTCAGTGGCACAACAGAGGCGAGCAAGAGGTGTTCGAGTACTGCCTGGAAGATGGC

AGCATCATCCGGGCCACCAAGGACCACAAGTTTATGACCACCGACGGCCAGATGCTGCCCAT

CGACGAGATCTTTGAGAGAGGCCTGGACCTGAAACAGGTGGACGGACTGCCTTGA
```

ABE7.10_Cfa-N_Split_T474C:

(SEQ ID NO: 139)

ATGAGCGAGGTGGAATTCAGCCACGAGTACTGGATGCGGCACGCCCTGACACTGGCCAAAAG

AGCTTGGGACGAGAGGGAAGTGCCTGTGGGAGCTGTGCTGGTGCACAACAACAGAGTGATCG

GCGAAGGCTGGAACAGACCCATCGGCAGACACGATCCTACAGCTCACGCCGAGATCATGGCC

CTGAGACAAGGCGGACTGGTCATGCAGAACTACCGGCTGATCGACGCCACACTGTACGTGAC

CCTGGAACCTTGCGTGATGTGTGCCGGCGCTATGATCCACAGCAGAATCGGCAGAGTGGTGT

TCGGCGCCAGAGATGCCAAAACAGGCGCTGCCGGAAGCCTGATGGATGTGCTGCATCACCCC

GGCATGAACCACAGAGTGGAAATCACCGAGGGCATCCTGGCCGATGAATGTGCCGCTCTGCT

GAGCGACTTCTTCCGGATGCGGCGGCAAGAGATCAAGGCCCAGAAGAAGGCCCAGTCCAGCA

CAGATAGCGGCGGATCTAGCGGAGGCAGCTCTGGATCTGAGACACCTGGCACAAGCGAGAGC

GCCACACCTGAAAGTTCTGGCGGTTCTTCTGGCGGCAGCAGCGAGGTCGAGTTCTCTCACGA

ATATTGGATGAGACACGCTCTCACCCTGGCTAAGAGAGCCAGGGACGAAAGAGAGGTGCCAG

TTGGCGCTGTCCTGGTGTTGAACAATCGCGTCATCGGAGAAGGATGGAATCGCGCCATTGGC

CTGCACGATCCAACCGCACATGCCGAAATTATGGCTCTGCGGCAAGGCGGCCTCGTGATGCA

AAATTACAGACTGATCGATGCTACCCTCTACGTCACCTTCGAGCCCTGTGTCATGTGTGCTG

GGGCAATGATTCACTCCCGGATTGGCCGCGTGGTGTTTGGAGTGCGGAATGCCAAGACTGGC

GCCGCTGGATCTCTGATGGACGTCCTGCACTATCCTGGGATGAACCACCGGGTCGAGATCAC

AGAGGGAATTCTGGCTGACGAGTGCGCTGCCCTGCTGTGCTACTTCTTTAGAATGCCCAGAC

AGGTGTTCAACGCCCAGAAAAAAGCTCAGAGCAGCACCGATTCCGGCGGAAGCAGCGGAGGA

TCTTCTGGAAGCGAAACCCCAGGCACCAGCGAGTCTGCCACACCAGAATCATCTGGCGGTAG

CTCCGGCGGCAGCGACAAGAAGTATTCTATCGGACTGGCCATCGGCACCAACTCTGTTGGAT

GGGCCGTGATCACCGACGAGTACAAGGTGCCCAGCAAGAAATTCAAGGTGCTGGGCAACACC

GACAGGCACAGCATCAAGAAGAACCTGATCGGCGCACTGCTGTTCGACTCTGGCGAAACAGC

CGAGGCCACCAGACTGAAGAGAACAGCCCGCAGACGGTACACCAGAAGAAAGAACCGGATCT

GCTACCTCCAAGAGATCTTCAGCAACGAGATGGCCAAGGTGGACGACAGCTTCTTCCACAGA

CTGGAAGAGTCCTTCCTGGTGGAAGAGGACAAGAAGCACGAGAGACACCCCATCTTCGGCAA

CATCGTGGACGAGGTGGCCTACCACGAGAAGTACCCCACCATCTACCACCTGAGAAAGAAAC

TGGTGGACAGCACCGACAAGGCCGACCTGAGACTGATCTATCTGGCCCTGGCTCACATGATC

AAGTTCCGGGGCCACTTCCTGATCGAGGGCGACCTGAATCCTGACAACAGCGACGTGGACAA

GCTGTTCATCCAGCTGGTGCAGACCTACAACCAGCTGTTCGAGGAAAACCCCATCAACGCCA

GCGGAGTGGATGCCAAGGCCATCCTGTCTGCCAGACTGAGCAAGAGCAGACGGCTGGAAAAT

CTGATCGCCCAGCTGCCTGGCGAGAAGAAGAATGGCCTGTTCGGCAACCTGATTGCCCTGAG

CCTGGGCCTGACACCTAACTTCAAGAGCAACTTCGACCTGGCCGAGGACGCCAAACTGCAGC

TGAGCAAGGACACCTACGACGACGACCTGGACAATCTGCTGGCCCAGATCGGCGATCAGTAC

GCCGACTTGTTTCTGGCCGCCAAGAATCTGAGCGACGCCATCCTGCTGTCCGACATCCTGAG

AGTGAACACCGAGATCACCAAGGCACCTCTGAGCGCCTCTATGATCAAGAGATACGACGAGC

ACCACCAGGATCTGACCCTGCTGAAGGCCCTCGTTAGACAGCAGCTGCCAGAGAAGTACAAA

GAGATTTTCTTCGACCAGAGCAAGAACGGCTACGCCGGCTACATTGATGGCGGAGCCAGCCA

AGAGGAATTCTACAAGTTCATCAAGCCCATCCTCGAGAAGATGGACGGCACCGAGGAACTGC

TGGTCAAGCTGAACAGAGAGGACCTGCTGAGAAAGCAGAGAACCTTCGACAACGGCAGCATC

-continued

CCTCACCAGATCCACCTGGGAGAACTGCACGCCATTCTGCGGAGACAAGAGGACTTTTACCC
ATTCCTGAAGGACAACCGGGAAAAGATCGAGAAAATCCTGACCTTCAGGATCCCCTACTACG
TGGGACCACTGGCCAGAGGCAATAGCAGATTCGCCTGGATGACCAGAAAGAGCGAGGAAACC
ATCTGCCTGAGCTACGATACCGAGATCCTGACCGTGGAATACGGCTTCCTGCCTATCGGCAA
GATCGTCGAGGAACGGATCGAGTGCACAGTGTACACCGTGGATAAGAATGGCTTCGTGTACA
CCCAGCCTATCGCTCAGTGGCACAACAGAGGCGAGCAAGAGGTGTTCGAGTACTGCCTGGAA
GATGGCAGCATCATCCGGGCCACCAAGGACCACAAGTTTATGACCACCGACGGCCAGATGCT
GCCCATCGACGAGATCTTTGAGAGAGGCCTGGACCTGAAACAGGTGGACGGACTGCCTTGA

ABE7.10_Cfa-N_Split_C574C:

(SEQ ID NO: 140)

ATGAGCGAGGTGGAATTCAGCCACGAGTACTGGATGCGGCACGCCCTGACACTGGCCAAAAG
AGCTTGGGACGAGAGGGAAGTGCCTGTGGGAGCTGTGCTGGTGCACAACAACAGAGTGATCG
GCGAAGGCTGGAACAGACCCATCGGCAGACACGATCCTACAGCTCACGCCGAGATCATGGCC
CTGAGACAAGGCGGACTGGTCATGCAGAACTACCGGCTGATCGACGCCACACTGTACGTGAC
CCTGGAACCTTGCGTGATGTGTGCCGGCGCTATGATCCACAGCAGAATCGGCAGAGTGGTGT
TCGGCGCCAGAGATGCCAAAACAGGCGCTGCCGGAAGCCTGATGGATGTGCTGCATCACCCC
GGCATGAACCACAGAGTGGAAATCACCGAGGGCATCCTGGCCGATGAATGTGCCGCTCTGCT
GAGCGACTTCTTCCGGATGCGGCGGCAAGAGATCAAGGCCCAGAAGAAGGCCCAGTCCAGCA
CAGATAGCGGCGGATCTAGCGGAGGCAGCTCTGGATCTGAGACACCTGGCACAAGCGAGAGC
GCCACACCTGAAAGTTCTGGCGGTTCTTCTGGCGGCAGCAGCGAGGTCGAGTTCTCTCACGA
ATATTGGATGAGACACGCTCTCACCCTGGCTAAGAGAGCCAGGGACGAAAGAGAGGTGCCAG
TTGGCGCTGTCCTGGTGTTGAACAATCGCGTCATCGGAGAAGGATGGAATCGCGCCATTGGC
CTGCACGATCCAACCGCACATGCCGAAATTATGGCTCTGCGGCAAGGCGGCCTCGTGATGCA
AAATTACAGACTGATCGATGCTACCCTCTACGTCACCTTCGAGCCCTGTGTCATGTGTGCTG
GGGCAATGATTCACTCCCGGATTGGCCGCGTGGTGTTTGGAGTGCGGAATGCCAAGACTGGC
GCCGCTGGATCTCTGATGGACGTCCTGCACTATCCTGGGATGAACCACCGGGTCGAGATCAC
AGAGGGAATTCTGGCTGACGAGTGCGCTGCCCTGCTGTGCTACTTCTTTAGAATGCCCAGAC
AGGTGTTCAACGCCCAGAAAAAAGCTCAGAGCAGCACCGATTCCGGCGGAAGCAGCGGAGGA
TCTTCTGGAAGCGAAACCCCAGGCACCAGCGAGTCTGCCACACCAGAATCATCTGGCGGTAG
CTCCGGCGGCAGCGACAAGAAGTATTCTATCGGACTGGCCATCGGCACCAACTCTGTTGGAT
GGGCCGTGATCACCGACGAGTACAAGGTGCCCAGCAAGAAATTCAAGGTGCTGGGCAACACC
GACAGGCACAGCATCAAGAAGAACCTGATCGGCGCACTGCTGTTCGACTCTGGCGAAACAGC
CGAGGCCACCAGACTGAAGAGAACAGCCCGCAGACGGTACACCAGAAGAAAGAACCGGATCT
GCTACCTCCAAGAGATCTTCAGCAACGAGATGGCCAAGGTGGACGACAGCTTCTTCCACAGA
CTGGAAGAGTCCTTCCTGGTGGAAGAGGACAAGAAGCACGAGAGACACCCCATCTTCGGCAA
CATCGTGGACGAGGTGGCCTACCACGAGAAGTACCCCACCATCTACCACCTGAGAAAGAAAC
TGGTGGACAGCACCGACAAGGCCGACCTGAGACTGATCTATCTGGCCCTGGCTCACATGATC
AAGTTCCGGGGCCACTTCCTGATCGAGGGCGACCTGAATCCTGACAACAGCGACGTGGACAA
GCTGTTCATCCAGCTGGTGCAGACCTACAACCAGCTGTTCGAGGAAAACCCCATCAACGCCA
GCGGAGTGGATGCCAAGGCCATCCTGTCTGCCAGACTGAGCAAGAGCAGACGGCTGGAAAAT
CTGATCGCCCAGCTGCCTGGCGAGAAGAAGAATGGCCTGTTCGGCAACCTGATTGCCCTGAG
CCTGGGCCTGACACCTAACTTCAAGAGCAACTTCGACCTGGCCGAGGACGCCAAACTGCAGC

-continued

TGAGCAAGGACACCTACGACGACGACCTGGACAATCTGCTGGCCCAGATCGGCGATCAGTAC

GCCGACTTGTTTCTGGCCGCCAAGAATCTGAGCGACGCCATCCTGCTGTCCGACATCCTGAG

AGTGAACACCGAGATCACCAAGGCACCTCTGAGCGCCTCTATGATCAAGAGATACGACGAGC

ACCACCAGGATCTGACCCTGCTGAAGGCCCTCGTTAGACAGCAGCTGCCAGAGAAGTACAAA

GAGATTTTCTTCGACCAGAGCAAGAACGGCTACGCCGGCTACATTGATGGCGGAGCCAGCCA

AGAGGAATTCTACAAGTTCATCAAGCCCATCCTCGAGAAGATGGACGGCACCGAGGAACTGC

TGGTCAAGCTGAACAGAGAGGACCTGCTGAGAAAGCAGAGAACCTTCGACAACGGCAGCATC

CCTCACCAGATCCACCTGGGAGAACTGCACGCCATTCTGCGGAGACAAGAGGACTTTTACCC

ATTCCTGAAGGACAACCGGGAAAAGATCGAGAAAATCCTGACCTTCAGGATCCCCTACTACG

TGGGACCACTGGCCAGAGGCAATAGCAGATTCGCCTGGATGACCAGAAAGAGCGAGGAAACC

ATCACTCCCTGGAACTTCGAGGAAGTGGTGGACAAGGGCGCCAGCGCTCAGTCCTTCATCGA

GCGGATGACCAACTTCGATAAGAACCTGCCTAACGAGAAGGTGCTGCCCAAGCACAGCCTGC

TGTACGAGTACTTCACCGTGTACAACGAGCTGACCAAAGTGAAATACGTGACCGAGGGAATG

AGAAAGCCCGCCTTTCTGAGCGGCGAGCAGAAAAAGGCCATCGTGGATCTGCTGTTCAAGAC

CAACCGGAAAGTGACCGTGAAGCAGCTGAAAGAGGACTACTTCAAGAAAATCGAGTGCCTGA

GCTACGATACCGAGATCCTGACCGTGGAATACGGCTTCCTGCCTATCGGCAAGATCGTCGAG

GAACGGATCGAGTGCACAGTGTACACCGTGGATAAGAATGGCTTCGTGTACACCCAGCCTAT

CGCTCAGTGGCACAACAGAGGCGAGCAAGAGGTGTTCGAGTACTGCCTGGAAGATGGCAGCA

TCATCCGGGCCACCAAGGACCACAAGTTTATGACCACCGACGGCCAGATGCTGCCCATCGAC

GAGATCTTTGAGAGAGGCCTGGACCTGAAACAGGTGGACGGACTGCCTTGA

ABE7.10_Cfa-N_Split_S577C:

(SEQ ID NO: 141)

ATGAGCGAGGTGGAATTCAGCCACGAGTACTGGATGCGGCACGCCCTGACACTGGCCAAAAG

AGCTTGGGACGAGAGGGAAGTGCCTGTGGGAGCTGTGCTGGTGCACAACAACAGAGTGATCG

GCGAAGGCTGGAACAGACCCATCGGCAGACACGATCCTACAGCTCACGCCGAGATCATGGCC

CTGAGACAAGGCGGACTGGTCATGCAGAACTACCGGCTGATCGACGCCACACTGTACGTGAC

CCTGGAACCTTGCGTGATGTGTGCCGGCGCTATGATCCACAGCAGAATCGGCAGAGTGGTGT

TCGGCGCCAGAGATGCCAAAACAGGCGCTGCCGGAAGCCTGATGGATGTGCTGCATCACCCC

GGCATGAACCACAGAGTGGAAATCACCGAGGGCATCCTGGCCGATGAATGTGCCGCTCTGCT

GAGCGACTTCTTCCGGATGCGGCGGCAAGAGATCAAGGCCCAGAAGAAGGCCCAGTCCAGCA

CAGATAGCGGCGGATCTAGCGGAGGCAGCTCTGGATCTGAGACACCTGGCACAAGCGAGAGC

GCCACACCTGAAAGTTCTGGCGGTTCTTCTGGCGGCAGCAGCGAGGTCGAGTTCTCTCACGA

ATATTGGATGAGACACGCTCTCACCCTGGCTAAGAGAGCCAGGGACGAAAGAGAGGTGCCAG

TTGGCGCTGTCCTGGTGTTGAACAATCGCGTCATCGGAGAAGGATGGAATCGCGCCATTGGC

CTGCACGATCCAACCGCACATGCCGAAATTATGGCTCTGCGGCAAGGCGGCCTCGTGATGCA

AAATTACAGACTGATCGATGCTACCCTCTACGTCACCTTCGAGCCCTGTGTCATGTGTGCTG

GGGCAATGATTCACTCCCGGATTGGCCGCGTGGTGTTTGGAGTGCGGAATGCCAAGACTGGC

GCCGCTGGATCTCTGATGGACGTCCTGCACTATCCTGGGATGAACCACCGGGTCGAGATCAC

AGAGGGAATTCTGGCTGACGAGTGCGCTGCCCTGCTGTGCTACTTCTTTAGAATGCCCAGAC

AGGTGTTCAACGCCCAGAAAAAAGCTCAGAGCAGCACCGATTCCGGCGGAAGCAGCGGAGGA

TCTTCTGGAAGCGAAACCCCAGGCACCAGCGAGTCTGCCACACCAGAATCATCTGGCGGTAG

-continued

CTCCGGCGGCAGCGACAAGAAGTATTCTATCGGACTGGCCATCGGCACCAACTCTGTTGGAT

GGGCCGTGATCACCGACGAGTACAAGGTGCCCAGCAAGAAATTCAAGGTGCTGGGCAACACC

GACAGGCACAGCATCAAGAAGAACCTGATCGGCGCACTGCTGTTCGACTCTGGCGAAACAGC

CGAGGCCACCAGACTGAAGAGAACAGCCCGCAGACGGTACACCAGAAGAAAGAACCGGATCT

GCTACCTCCAAGAGATCTTCAGCAACGAGATGGCCAAGGTGGACGACAGCTTCTTCCACAGA

CTGGAAGAGTCCTTCCTGGTGGAAGAGGACAAGAAGCACGAGAGACACCCCATCTTCGGCAA

CATCGTGGACGAGGTGGCCTACCACGAGAAGTACCCCACCATCTACCACCTGAGAAAGAAAC

TGGTGGACAGCACCGACAAGGCCGACCTGAGACTGATCTATCTGGCCCTGGCTCACATGATC

AAGTTCCGGGGCCACTTCCTGATCGAGGGCGACCTGAATCCTGACAACAGCGACGTGGACAA

GCTGTTCATCCAGCTGGTGCAGACCTACAACCAGCTGTTCGAGGAAAACCCCATCAACGCCA

GCGGAGTGGATGCCAAGGCCATCCTGTCTGCCAGACTGAGCAAGAGCAGACGGCTGGAAAAT

CTGATCGCCCAGCTGCCTGGCGAGAAGAAGAATGGCCTGTTCGGCAACCTGATTGCCCTGAG

CCTGGGCCTGACACCTAACTTCAAGAGCAACTTCGACCTGGCCGAGGACGCCAAACTGCAGC

TGAGCAAGGACACCTACGACGACGACCTGGACAATCTGCTGGCCCAGATCGGCGATCAGTAC

GCCGACTTGTTTCTGGCCGCCAAGAATCTGAGCGACGCCATCCTGCTGTCCGACATCCTGAG

AGTGAACACCGAGATCACCAAGGCACCTCTGAGCGCCTCTATGATCAAGAGATACGACGAGC

ACCACCAGGATCTGACCCTGCTGAAGGCCCTCGTTAGACAGCAGCTGCCAGAGAAGTACAAA

GAGATTTTCTTCGACCAGAGCAAGAACGGCTACGCCGGCTACATTGATGGCGGAGCCAGCCA

AGAGGAATTCTACAAGTTCATCAAGCCCATCCTCGAGAAGATGGACGGCACCGAGGAACTGC

TGGTCAAGCTGAACAGAGAGGACCTGCTGAGAAAGCAGAGAACCTTCGACAACGGCAGCATC

CCTCACCAGATCCACCTGGGAGAACTGCACGCCATTCTGCGGAGACAAGAGGACTTTTACCC

ATTCCTGAAGGACAACCGGGAAAAGATCGAGAAAATCCTGACCTTCAGGATCCCCTACTACG

TGGGACCACTGGCCAGAGGCAATAGCAGATTCGCCTGGATGACCAGAAAGAGCGAGGAAACC

ATCACTCCCTGGAACTTCGAGGAAGTGGTGGACAAGGGCGCCAGCGCTCAGTCCTTCATCGA

GCGGATGACCAACTTCGATAAGAACCTGCCTAACGAGAAGGTGCTGCCCAAGCACAGCCTGC

TGTACGAGTACTTCACCGTGTACAACGAGCTGACCAAAGTGAAATACGTGACCGAGGGAATG

AGAAAGCCCGCCTTTCTGAGCGGCGAGCAGAAAAAGGCCATCGTGGATCTGCTGTTCAAGAC

CAACCGGAAAGTGACCGTGAAGCAGCTGAAAGAGGACTACTTCAAGAAAATCGAGTGCTTCG

ACTGCCTGAGCTACGATACCGAGATCCTGACCGTGGAATACGGCTTCCTGCCTATCGGCAAG

ATCGTCGAGGAACGGATCGAGTGCACAGTGTACACCGTGGATAAGAATGGCTTCGTGTACAC

CCAGCCTATCGCTCAGTGGCACAACAGAGGCGAGCAAGAGGTGTTCGAGTACTGCCTGGAAG

ATGGCAGCATCATCCGGGCCACCAAGGACCACAAGTTTATGACCACCGACGGCCAGATGCTG

CCCATCGACGAGATCTTTGAGAGAGGCCTGGACCTGAAACAGGTGGACGGACTGCCTTGA

ABE7.10_Cfa-N_Split_A589C:

(SEQ ID NO: 142)
ATGAGCGAGGTGGAATTCAGCCACGAGTACTGGATGCGGCACGCCCTGACACTGGCCAAAAG

AGCTTGGGACGAGAGGGAAGTGCCTGTGGGAGCTGTGCTGGTGCACAACAACAGAGTGATCG

GCGAAGGCTGGAACAGACCCATCGGCAGACACGATCCTACAGCTCACGCCGAGATCATGGCC

CTGAGACAAGGCGGACTGGTCATGCAGAACTACCGGCTGATCGACGCCACACTGTACGTGAC

CCTGGAACCTTGCGTGATGTGTGCCGGCGCTATGATCCACAGCAGAATCGGCAGAGTGGTGT

TCGGCGCCAGAGATGCCAAAACAGGCGCTGCCGGAAGCCTGATGGATGTGCTGCATCACCCC

GGCATGAACCACAGAGTGGAAATCACCGAGGGCATCCTGGCCGATGAATGTGCCGCTCTGCT

-continued

```
GAGCGACTTCTTCCGGATGCGGCGGCAAGAGATCAAGGCCCAGAAGAAGGCCCAGTCCAGCA

CAGATAGCGGCGGATCTAGCGGAGGCAGCTCTGGATCTGAGACACCTGGCACAAGCGAGAGC

GCCACACCTGAAAGTTCTGGCGGTTCTTCTGGCGGCAGCAGCGAGGTCGAGTTCTCTCACGA

ATATTGGATGAGACACGCTCTCACCCTGGCTAAGAGAGCCAGGGACGAAAGAGAGGTGCCAG

TTGGCGCTGTCCTGGTGTTGAACAATCGCGTCATCGGAGAAGGATGGAATCGCGCCATTGGC

CTGCACGATCCAACCGCACATGCCGAAATTATGGCTCTGCGGCAAGGCGGCCTCGTGATGCA

AAATTACAGACTGATCGATGCTACCCTCTACGTCACCTTCGAGCCCTGTGTCATGTGTGCTG

GGGCAATGATTCACTCCCGGATTGGCCGCGTGGTGTTTGGAGTGCGGAATGCCAAGACTGGC

GCCGCTGGATCTCTGATGGACGTCCTGCACTATCCTGGGATGAACCACCGGGTCGAGATCAC

AGAGGGAATTCTGGCTGACGAGTGCGCTGCCCTGCTGTGCTACTTCTTTAGAATGCCCAGAC

AGGTGTTCAACGCCCAGAAAAAAGCTCAGAGCAGCACCGATTCCGGCGGAAGCAGCGGAGGA

TCTTCTGGAAGCGAAACCCCAGGCACCAGCGAGTCTGCCACACCAGAATCATCTGGCGGTAG

CTCCGGCGGCAGCGACAAGAAGTATTCTATCGGACTGGCCATCGGCACCAACTCTGTTGGAT

GGGCCGTGATCACCGACGAGTACAAGGTGCCCAGCAAGAAATTCAAGGTGCTGGGCAACACC

GACAGGCACAGCATCAAGAAGAACCTGATCGGCGCACTGCTGTTCGACTCTGGCGAAACAGC

CGAGGCCACCAGACTGAAGAGAACAGCCCGCAGACGGTACACCAGAAGAAAGAACCGGATCT

GCTACCTCCAAGAGATCTTCAGCAACGAGATGGCCAAGGTGGACGACAGCTTCTTCCACAGA

CTGGAAGAGTCCTTCCTGGTGGAAGAGGACAAGAAGCACGAGAGACACCCCATCTTCGGCAA

CATCGTGGACGAGGTGGCCTACCACGAGAAGTACCCCACCATCTACCACCTGAGAAAGAAAC

TGGTGGACAGCACCGACAAGGCCGACCTGAGACTGATCTATCTGGCCCTGGCTCACATGATC

AAGTTCCGGGGCCACTTCCTGATCGAGGGCGACCTGAATCCTGACAACAGCGACGTGGACAA

GCTGTTCATCCAGCTGGTGCAGACCTACAACCAGCTGTTCGAGGAAAACCCCATCAACGCCA

GCGGAGTGGATGCCAAGGCCATCCTGTCTGCCAGACTGAGCAAGAGCAGACGGCTGGAAAAT

CTGATCGCCCAGCTGCCTGGCGAGAAGAAGAATGGCCTGTTCGGCAACCTGATTGCCCTGAG

CCTGGGCCTGACACCTAACTTCAAGAGCAACTTCGACCTGGCCGAGGACGCCAAACTGCAGC

TGAGCAAGGACACCTACGACGACGACCTGGACAATCTGCTGGCCCAGATCGGCGATCAGTAC

GCCGACTTGTTTCTGGCCGCCAAGAATCTGAGCGACGCCATCCTGCTGTCCGACATCCTGAG

AGTGAACACCGAGATCACCAAGGCACCTCTGAGCGCCTCTATGATCAAGAGATACGACGAGC

ACCACCAGGATCTGACCCTGCTGAAGGCCCTCGTTAGACAGCAGCTGCCAGAGAAGTACAAA

GAGATTTTCTTCGACCAGAGCAAGAACGGCTACGCCGGCTACATTGATGGCGGAGCCAGCCA

AGAGGAATTCTACAAGTTCATCAAGCCCATCCTCGAGAAGATGGACGGCACCGAGGAACTGC

TGGTCAAGCTGAACAGAGAGGACCTGCTGAGAAAGCAGAGAACCTTCGACAACGGCAGCATC

CCTCACCAGATCCACCTGGGAGAACTGCACGCCATTCTGCGGAGACAAGAGGACTTTTACCC

ATTCCTGAAGGACAACCGGGAAAAGATCGAGAAAATCCTGACCTTCAGGATCCCCTACTACG

TGGGACCACTGGCCAGAGGCAATAGCAGATTCGCCTGGATGACCAGAAAGAGCGAGGAAACC

ATCACTCCCTGGAACTTCGAGGAAGTGGTGGACAAGGGCGCCAGCGCTCAGTCCTTCATCGA

GCGGATGACCAACTTCGATAAGAACCTGCCTAACGAGAAGGTGCTGCCCAAGCACAGCCTGC

TGTACGAGTACTTCACCGTGTACAACGAGCTGACCAAAGTGAAATACGTGACCGAGGGAATG

AGAAAGCCCGCCTTTCTGAGCGGCGAGCAGAAAAAGGCCATCGTGGATCTGCTGTTCAAGAC

CAACCGGAAAGTGACCGTGAAGCAGCTGAAAGAGGACTACTTCAAGAAAATCGAGTGCTTCG
```

-continued

ACAGCGTCGAGATCTCCGGCGTGGAAGATCGGTTCAATTGCCTGAGCTACGATACCGAGATC

CTGACCGTGGAATACGGCTTCCTGCCTATCGGCAAGATCGTCGAGGAACGGATCGAGTGCAC

AGTGTACACCGTGGATAAGAATGGCTTCGTGTACACCCAGCCTATCGCTCAGTGGCACAACA

GAGGCGAGCAAGAGGTGTTCGAGTACTGCCTGGAAGATGGCAGCATCATCCGGGCCACCAAG

GACCACAAGTTTATGACCACCGACGGCCAGATGCTGCCCATCGACGAGATCTTTGAGAGG

CCTGGACCTGAAACAGGTGGACGGACTGCCTTGA

ABE7.10_Cfa-N_Split_S590C:

(SEQ ID NO: 143)

ATGAGCGAGGTGGAATTCAGCCACGAGTACTGGATGCGGCACGCCCTGACACTGGCCAAAAG

AGCTTGGGACGAGAGGGAAGTGCCTGTGGGAGCTGTGCTGGTGCACAACAACAGAGTGATCG

GCGAAGGCTGGAACAGACCCATCGGCAGACACGATCCTACAGCTCACGCCGAGATCATGGCC

CTGAGACAAGGCGGACTGGTCATGCAGAACTACCGGCTGATCGACGCCACACTGTACGTGAC

CCTGGAACCTTGCGTGATGTGTGCCGGCGCTATGATCCACAGCAGAATCGGCAGAGTGGTGT

TCGGCGCCAGAGATGCCAAAACAGGCGCTGCCGGAAGCCTGATGGATGTGCTGCATCACCCC

GGCATGAACCAGAGTGGAAATCACCGAGGGCATCCTGGCCGATGAATGTGCCGCTCTGCT

GAGCGACTTCTTCCGGATGCGGCGGCAAGAGATCAAGGCCCAGAAGAAGGCCCAGTCCAGCA

CAGATAGCGGCGGATCTAGCGGAGGCAGCTCTGGATCTGAGACACCTGGCACAAGCGAGAGC

GCCACACCTGAAAGTTCTGGCGGTTCTTCTGGCGGCAGCAGCGAGGTCGAGTTCTCTCACGA

ATATTGGATGAGACACGCTCTCACCCTGGCTAAGAGAGCCAGGGACGAAAGAGAGGTGCCAG

TTGGCGCTGTCCTGGTGTTGAACAATCGCGTCATCGGAGAAGGATGGAATCGCGCCATTGGC

CTGCACGATCCAACCGCACATGCCGAAATTATGGCTCTGCGGCAAGGCGGCCTCGTGATGCA

AAATTACAGACTGATCGATGCTACCCTCTACGTCACCTTCGAGCCCTGTGTCATGTGTGCTG

GGGCAATGATTCACTCCCGGATTGGCCGCGTGGTGTTTGGAGTGCGGAATGCCAAGACTGGC

GCCGCTGGATCTCTGATGGACGTCCTGCACTATCCTGGGATGAACCACCGGGTCGAGATCAC

AGAGGGAATTCTGGCTGACGAGTGCGCTGCCCTGCTGTGCTACTTCTTTAGAATGCCCAGAC

AGGTGTTCAACGCCCAGAAAAAAGCTCAGAGCAGCACCGATTCCGGCGGAAGCAGCGGAGGA

TCTTCTGGAAGCGAAACCCCAGGCACCAGCGAGTCTGCCACACCAGAATCATCTGGCGGTAG

CTCCGGCGGCAGCGACAAGAAGTATTCTATCGGACTGGCCATCGGCACCAACTCTGTTGGAT

GGGCCGTGATCACCGACGAGTACAAGGTGCCCAGCAAGAAATTCAAGGTGCTGGGCAACACC

GACAGGCACAGCATCAAGAAGAACCTGATCGGCGCACTGCTGTTCGACTCTGGCGAAACAGC

CGAGGCCACCAGACTGAAGAGAACAGCCCGCAGACGGTACACCAGAAGAAAGAACCGGATCT

GCTACCTCCAAGAGATCTTCAGCAACGAGATGGCCAAGGTGGACGACAGCTTCTTCCACAGA

CTGGAAGAGTCCTTCCTGGTGGAAGAGGACAAGAAGCACGAGAGACACCCCATCTTCGGCAA

CATCGTGGACGAGGTGGCCTACCACGAGAAGTACCCCACCATCTACCACCTGAGAAAGAAAC

TGGTGGACAGCACCGACAAGGCCGACCTGAGACTGATCTATCTGGCCCTGGCTCACATGATC

AAGTTCCGGGGCCACTTCCTGATCGAGGGCGACCTGAATCCTGACAACAGCGACGTGGACAA

GCTGTTCATCCAGCTGGTGCAGACCTACAACCAGCTGTTCGAGGAAAACCCCATCAACGCCA

GCGGAGTGGATGCCAAGGCCATCCTGTCTGCCAGACTGAGCAAGAGCAGACGGCTGGAAAAT

CTGATCGCCCAGCTGCCTGGCGAGAAGAAGAATGGCCTGTTCGGCAACCTGATTGCCCTGAG

CCTGGGCCTGACACCTAACTTCAAGAGCAACTTCGACCTGGCCGAGGACGCCAAACTGCAGC

TGAGCAAGGACACCTACGACGACGACCTGGACAATCTGCTGGCCCAGATCGGCGATCAGTAC

GCCGACTTGTTTCTGGCCGCCAAGAATCTGAGCGACGCCATCCTGCTGTCCGACATCCTGAG

-continued

```
AGTGAACACCGAGATCACCAAGGCACCTCTGAGCGCCTCTATGATCAAGAGATACGACGAGC
ACCACCAGGATCTGACCCTGCTGAAGGCCCTCGTTAGACAGCAGCTGCCAGAGAAGTACAAA
GAGATTTTCTTCGACCAGAGCAAGAACGGCTACGCCGGCTACATTGATGGCGGAGCCAGCCA
AGAGGAATTCTACAAGTTCATCAAGCCCATCCTCGAGAAGATGGACGGCACCGAGGAACTGC
TGGTCAAGCTGAACAGAGAGGACCTGCTGAGAAAGCAGAGAACCTTCGACAACGGCAGCATC
CCTCACCAGATCCACCTGGGAGAACTGCACGCCATTCTGCGGAGACAAGAGGACTTTTACCC
ATTCCTGAAGGACAACCGGGAAAAGATCGAGAAAATCCTGACCTTCAGGATCCCCTACTACG
TGGGACCACTGGCCAGAGGCAATAGCAGATTCGCCTGGATGACCAGAAAGAGCGAGGAAACC
ATCACTCCCTGGAACTTCGAGGAAGTGGTGGACAAGGGCGCCAGCGCTCAGTCCTTCATCGA
GCGGATGACCAACTTCGATAAGAACCTGCCTAACGAGAAGGTGCTGCCCAAGCACAGCCTGC
TGTACGAGTACTTCACCGTGTACAACGAGCTGACCAAAGTGAAATACGTGACCGAGGGAATG
AGAAAGCCCGCCTTTCTGAGCGGCGAGCAGAAAAAGGCCATCGTGGATCTGCTGTTCAAGAC
CAACCGGAAAGTGACCGTGAAGCAGCTGAAAGAGGACTACTTCAAGAAAATCGAGTGCTTCG
ACAGCGTCGAGATCTCCGGCGTGGAAGATCGGTTCAATGCCTGCCTGAGCTACGATACCGAG
ATCCTGACCGTGGAATACGGCTTCCTGCCTATCGGCAAGATCGTCGAGGAACGGATCGAGTG
CACAGTGTACACCGTGGATAAGAATGGCTTCGTGTACACCCAGCCTATCGCTCAGTGGCACA
ACAGAGGCGAGCAAGAGGTGTTCGAGTACTGCCTGGAAGATGGCAGCATCATCCGGGCCACC
AAGGACCACAAGTTTATGACCACCGACGGCCAGATGCTGCCCATCGACGAGATCTTTGAGAG
AGGCCTGGACCTGAAACAGGTGGACGGACTGCCTTGA
```

ABE7.10_Cfa-N_Split_S-1C:
(SEQ ID NO: 144)
```
ATGAGCGAGGTGGAATTCAGCCACGAGTACTGGATGCGGCACGCCCTGACACTGGCCAAAAG
AGCTTGGGACGAGAGGGAAGTGCCTGTGGGAGCTGTGCTGGTGCACAACAACAGAGTGATCG
GCGAAGGCTGGAACAGACCCATCGGCAGACACGATCCTACAGCTCACGCCGAGATCATGGCC
CTGAGACAAGGCGGACTGGTCATGCAGAACTACCGGCTGATCGACGCCACACTGTACGTGAC
CCTGGAACCTTGCGTGATGTGTGCCGGCGCTATGATCCACAGCAGAATCGGCAGAGTGGTGT
TCGGCGCCAGAGATGCCAAAACAGGCGCTGCCGGAAGCCTGATGGATGTGCTGCATCACCCC
GGCATGAACCACAGAGTGGAAATCACCGAGGGCATCCTGGCCGATGAATGTGCCGCTCTGCT
GAGCGACTTCTTCCGGATGCGGCGGCAAGAGATCAAGGCCCAGAAGAAGGCCCAGTCCAGCA
CAGATAGCGGCGGATCTAGCGGAGGCAGCTCTGGATCTGAGACACCTGGCACAAGCGAGAGC
GCCACACCTGAAAGTTCTGGCGGTTCTTCTGGCGGCAGCAGCGAGGTCGAGTTCTCTCACGA
ATATTGGATGAGACACGCTCTCACCCTGGCTAAGAGAGCCAGGGACGAAAGAGAGGTGCCAG
TTGGCGCTGTCCTGGTGTTGAACAATCGCGTCATCGGAGAAGGATGGAATCGCGCCATTGGC
CTGCACGATCCAACCGCACATGCCGAAATTATGGCTCTGCGGCAAGGCGGCCTCGTGATGCA
AAATTACAGACTGATCGATGCTACCCTCTACGTCACCTTCGAGCCCTGTGTCATGTGTGCTG
GGGCAATGATTCACTCCCGGATTGGCCGCGTGGTGTTTGGAGTGCGGAATGCCAAGACTGGC
GCCGCTGGATCTCTGATGGACGTCCTGCACTATCCTGGGATGAACCACCGGGTCGAGATCAC
AGAGGGAATTCTGGCTGACGAGTGCGCTGCCCTGCTGTGCTACTTCTTTAGAATGCCCAGAC
AGGTGTTCAACGCCCAGAAAAAGCTCAGAGCAGCACCGATTCCGGCGGAAGCAGCGGAGGA
TCTTCTGGAAGCGAAACCCCAGGCACCAGCGAGTCTGCCACACCAGAATCATCTGGCGGTAG
CTCCGGCGGCTGCCTGAGCTACGATACCGAGATCCTGACCGTGGAATACGGCTTCCTGCCTA
```

-continued

TCGGCAAGATCGTCGAGGAACGGATCGAGTGCACAGTGTACACCGTGGATAAGAATGGCTTC

GTGTACACCCAGCCTATCGCTCAGTGGCACAACAGAGGCGAGCAAGAGGTGTTCGAGTACTG

CCTGGAAGATGGCAGCATCATCCGGGCCACCAAGGACCACAAGTTTATGACCACCGACGGCC

AGATGCTGCCCATCGACGAGATCTTTGAGAGAGGCCTGGACCTGAAACAGGTGGACGGACTG

CCTTGA

ABE7.10_Cfa-N_Split_S-32C:

(SEQ ID NO: 145)

ATGAGCGAGGTGGAATTCAGCCACGAGTACTGGATGCGGCACGCCCTGACACTGGCCAAAAG

AGCTTGGGACGAGAGGGAAGTGCCTGTGGGAGCTGTGCTGGTGCACAACAACAGAGTGATCG

GCGAAGGCTGGAACAGACCCATCGGCAGACACGATCCTACAGCTCACGCCGAGATCATGGCC

CTGAGACAAGGCGGACTGGTCATGCAGAACTACCGGCTGATCGACGCCACACTGTACGTGAC

CCTGGAACCTTGCGTGATGTGTGCCGGCGCTATGATCCACAGCAGAATCGGCAGAGTGGTGT

TCGGCGCCAGAGATGCCAAAACAGGCGCTGCCGGAAGCCTGATGGATGTGCTGCATCACCCC

GGCATGAACCACAGAGTGGAAATCACCGAGGGCATCCTGGCCGATGAATGTGCCGCTCTGCT

GAGCGACTTCTTCCGGATGCGGCGGCAAGAGATCAAGGCCCAGAAGAAGGCCCAGTCCAGCA

CAGATAGCGGCGGATCTAGCGGAGGCAGCTCTGGATCTGAGACACCTGGCACAAGCGAGAGC

GCCACACCTGAAAGTTCTGGCGGTTCTTCTGGCGGCAGCAGCGAGGTCGAGTTCTCTCACGA

ATATTGGATGAGACACGCTCTCACCCTGGCTAAGAGAGCCAGGGACGAAAGAGAGGTGCCAG

TTGGCGCTGTCCTGGTGTTGAACAATCGCGTCATCGGAGAAGGATGGAATCGCGCCATTGGC

CTGCACGATCCAACCGCACATGCCGAAATTATGGCTCTGCGGCAAGGCGGCCTCGTGATGCA

AAATTACAGACTGATCGATGCTACCCTCTACGTCACCTTCGAGCCCTGTGTCATGTGTGCTG

GGGCAATGATTCACTCCCGGATTGGCCGCGTGGTGTTTGGAGTGCGGAATGCCAAGACTGGC

GCCGCTGGATCTCTGATGGACGTCCTGCACTATCCTGGGATGAACCACCGGGTCGAGATCAC

AGAGGGAATTCTGGCTGACGAGTGCGCTGCCCTGCTGTGCTACTTCTTTAGAATGCCCAGAC

AGGTGTTCAACGCCCAGAAAAAAGCTCAGAGCAGCACCGATTGCCTGAGCTACGATACCGAG

ATCCTGACCGTGGAATACGGCTTCCTGCCTATCGGCAAGATCGTCGAGGAACGGATCGAGTG

CACAGTGTACACCGTGGATAAGAATGGCTTCGTGTACACCCAGCCTATCGCTCAGTGGCACA

ACAGAGGCGAGCAAGAGGTGTTCGAGTACTGCCTGGAAGATGGCAGCATCATCCGGGCCACC

AAGGACCACAAGTTTATGACCACCGACGGCCAGATGCTGCCCATCGACGAGATCTTTGAGAG

AGGCCTGGACCTGAAACAGGTGGACGGACTGCCTTGA

ABE7.10_Cfa(GEP)-C_Split_S303C:

(SEQ ID NO: 146)

ATGGTCAAGATCATCAGCAGAAAGAGCCTGGGCACCCAGAACGTGTACGATATCGGAGTGGG

CGAGCCCCACAACTTTCTGCTCAAGAATGGCCTGGTGGCCAGCAACTGCGACATCCTGAGAG

TGAACACCGAGATCACCAAGGCACCTCTGAGCGCCTCTATGATCAAGAGATACGACGAGCAC

CACCAGGATCTGACCCTGCTGAAGGCCCTCGTTAGACAGCAGCTGCCAGAGAAGTACAAAGA

GATTTTCTTCGACCAGAGCAAGAACGGCTACGCCGGCTACATTGATGGCGGAGCCAGCCAAG

AGGAATTCTACAAGTTCATCAAGCCCATCCTCGAGAAGATGGACGGCACCGAGGAACTGCTG

GTCAAGCTGAACAGAGAGGACCTGCTGAGAAAGCAGAGAACCTTCGACAACGGCAGCATCCC

TCACCAGATCCACCTGGGAGAACTGCACGCCATTCTGCGGAGACAAGAGGACTTTTACCCAT

TCCTGAAGGACAACCGGGAAAAGATCGAGAAAATCCTGACCTTCAGGATCCCCTACTACGTG

GGACCACTGGCCAGAGGCAATAGCAGATTCGCCTGGATGACCAGAAAGAGCGAGGAAACCAT

CACTCCCTGGAACTTCGAGGAAGTGGTGGACAAGGGCGCCAGCGCTCAGTCCTTCATCGAGC

-continued

```
GGATGACCAACTTCGATAAGAACCTGCCTAACGAGAAGGTGCTGCCCAAGCACAGCCTGCTG

TACGAGTACTTCACCGTGTACAACGAGCTGACCAAAGTGAAATACGTGACCGAGGGAATGAG

AAAGCCCGCCTTTCTGAGCGGCGAGCAGAAAAAGGCCATCGTGGATCTGCTGTTCAAGACCA

ACCGGAAAGTGACCGTGAAGCAGCTGAAAGAGGACTACTTCAAGAAAATCGAGTGCTTCGAC

AGCGTCGAGATCTCCGGCGTGGAAGATCGGTTCAATGCCAGCCTGGGCACATACCACGATCT

GCTGAAAATTATCAAGGACAAGGACTTCCTGGACAACGAAGAGAACGAGGACATCCTTGAGG

ACATCGTGCTGACACTGACCCTGTTTGAGGACAGAGAGATGATCGAGGAACGGCTGAAAACA

TACGCCCACCTGTTCGACGACAAAGTGATGAAGCAACTGAAGCGGCGGAGATACACCGGCTG

GGGCAGACTGTCTCGGAAGCTGATCAACGGCATCCGGGATAAGCAGTCCGGCAAGACCATCC

TGGACTTTCTGAAGTCCGACGGCTTCGCCAACAGAAACTTCATGCAGCTGATTCACGACGAC

AGCCTCACCTTCAAAGAGGATATCCAGAAAGCCCAGGTGTCCGGCCAGGGCGATTCTCTGCA

TGAGCACATTGCCAACCTGGCCGGCTCTCCCGCCATTAAGAAAGGCATCCTGCAGACAGTGA

AGGTGGTGGACGAGCTTGTGAAAGTGATGGGCAGACACAAGCCCGAGAACATCGTGATCGAA

ATGGCCAGAGAGAACCAGACCACACAGAAGGGACAGAAGAACAGCCGCGAGAGAATGAAGCG

GATCGAAGAGGGCATCAAAGAGCTGGGCAGCCAGATCCTGAAAGAACACCCCGTGGAAAACA

CCCAGCTGCAGAACGAGAAGCTGTACCTGTACTACCTGCAGAATGGACGGGATATGTACGTG

GACCAAGAGCTGGACATCAACAGACTGTCCGACTACGATGTGGACCATATCGTGCCCCAGTC

TTTTCTGAAGGACGACTCCATCGACAACAAGGTCCTGACCAGATCCGACAAGAATCGGGCA

AGAGCGACAACGTGCCCTCCGAAGAGGTGGTCAAGAAGATGAAGAACTACTGGCGACAGCTG

CTGAACGCCAAGCTGATTACCCAGCGGAAGTTCGACAATCTGACCAAGGCCGAAAGAGGCGG

CCTGAGCGAACTGGATAAGGCCGGCTTCATCAAGAGACAGCTGGTGGAAACCCGGCAGATCA

CAAAGCACGTGGCACAGATTCTGGACTCTCGGATGAACACTAAGTACGACGAGAACGACAAA

CTGATCCGCGAAGTGAAAGTCATCACCCTGAAGTCCAAGCTGGTGTCCGATTTCCGGAAGGA

TTTCCAGTTCTACAAAGTGCGCGAGATCAACAACTACCATCACGCCCACGACGCCTACCTGA

ATGCCGTTGTTGGAACAGCCCTGATCAAAAAGTACCCTAAGCTGGAAAGCGAGTTCGTGTAC

GGCGACTACAAGGTGTACGACGTGCGGAAGATGATCGCCAAGAGCGAGCAAGAGATTGGCAA

GGCAACCGCCAAGTACTTCTTCTACAGCAACATCATGAACTTTTTCAAGACAGAGATCACCC

TCGCCAACGGCGAGATCAGAAAGCGGCCTCTGATCGAGACAAACGGCGAAACCGGCGAGATT

GTGTGGGATAAGGGCAGAGACTTTGCCACAGTGCGGAAAGTGCTGAGCATGCCCCAAGTGAA

TATCGTGAAGAAAACCGAGGTGCAGACAGGCGGCTTCAGCAAAGAGTCTATCCTGCCTAAGC

GGAACTCCGACAAGCTGATCGCCAGAAAGAAGGACTGGGACCCCAAGAAGTACGGCGGCTTC

GATTCTCCTACCGTGGCCTATAGCGTGCTGGTGGTGGCCAAAGTGGAAAAGGGCAAGTCCAA

GAAACTCAAGAGCGTGAAAGAGCTGCTGGGGATCACCATCATGGAAAGAAGCAGCTTCGAGA

AGAATCCGATCGATTTCCTCGAGGCCAAGGGCTACAAAGAAGTGAAAAAGGACCTGATCATC

AAGCTCCCCAAGTACTCCCTGTTCGAGCTGGAAAACGGCCGGAAGAGAATGCTGGCCTCTGC

TGGCGAACTGCAGAAGGGAAACGAACTGGCCCTGCCTAGCAAATATGTGAACTTCCTGTACC

TGGCCAGCCACTATGAGAAGCTGAAGGGCAGCCCCGAGGACAATGAGCAAAAGCAGCTGTTT

GTGGAACAGCACAAGCACTACCTGGACGAGATCATCGAGCAGATCAGCGAGTTTAGCAAGAG

AGTGATTCTGGCCGACGCCAATCTGGACAAAGTGTGTCCGCCTACAACAAGCACCGGGACA

AGCCTATCAGAGAGCAGGCCGAGAATATCATCCACCTGTTTACCCTGACCAACCTGGGAGCC
```

-continued

CCTGCCGCCTTCAAGTACTTTGACACCACCATCGACCGGAAGCGGTACACCTCCACCAAAGA

GGTGCTGGACGCCACTCTGATCCACCAGTCTATCACCGGCCTGTACGAGACACGGATCGACC

TGTCTCAACTCGGAGGCGACGAAGGCGCCGATAAGAGAACCGCCGATGGCTCTGAGTTCGAG

AGCCCCAAGAAAAAGCGCAAAGTGTGA

ABE7.10_Cfa(GEP)-C_Split_T310C:

(SEQ ID NO: 147)

ATGGTCAAGATCATCAGCAGAAAGAGCCTGGGCACCCAGAACGTGTACGATATCGGAGTGGG

CGAGCCCCACAACTTTCTGCTCAAGAATGGCCTGGTGGCCAGCAACTGCGAGATCACCAAGG

CACCTCTGAGCGCCTCTATGATCAAGAGATACGACGAGCACCACCAGGATCTGACCCTGCTG

AAGGCCCTCGTTAGACAGCAGCTGCCAGAGAAGTACAAAGAGATTTTCTTCGACCAGAGCAA

GAACGGCTACGCCGGCTACATTGATGGCGGAGCCAGCCAAGAGGAATTCTACAAGTTCATCA

AGCCCATCCTCGAGAAGATGGACGGCACCGAGGAACTGCTGGTCAAGCTGAACAGAGAGGAC

CTGCTGAGAAAGCAGAGAACCTTCGACAACGGCAGCATCCCTCACCAGATCCACCTGGGAGA

ACTGCACGCCATTCTGCGGAGACAAGAGGACTTTTACCCATTCCTGAAGGACAACCGGGAAA

AGATCGAGAAAATCCTGACCTTCAGGATCCCCTACTACGTGGGACCACTGGCCAGAGGCAAT

AGCAGATTCGCCTGGATGACCAGAAAGAGCGAGGAAACCATCACTCCCTGGAACTTCGAGGA

AGTGGTGGACAAGGGCGCCAGCGCTCAGTCCTTCATCGAGCGGATGACCAACTTCGATAAGA

ACCTGCCTAACGAGAAGGTGCTGCCCAAGCACAGCCTGCTGTACGAGTACTTCACCGTGTAC

AACGAGCTGACCAAAGTGAAATACGTGACCGAGGGAATGAGAAAGCCCGCCTTTCTGAGCGG

CGAGCAGAAAAAGGCCATCGTGGATCTGCTGTTCAAGACCAACCGGAAAGTGACCGTGAAGC

AGCTGAAAGAGGACTACTTCAAGAAAATCGAGTGCTTCGACAGCGTCGAGATCTCCGGCGTG

GAAGATCGGTTCAATGCCAGCCTGGGCACATACCACGATCTGCTGAAAATTATCAAGGACAA

GGACTTCCTGGACAACGAAGAGAACGAGGACATCCTTGAGGACATCGTGCTGACACTGACCC

TGTTTGAGGACAGAGAGATGATCGAGGAACGGCTGAAAACATACGCCCACCTGTTCGACGAC

AAAGTGATGAAGCAACTGAAGCGGCGGAGATACACCGGCTGGGGCAGACTGTCTCGGAAGCT

GATCAACGGCATCCGGGATAAGCAGTCCGGCAAGACCATCCTGGACTTTCTGAAGTCCGACG

GCTTCGCCAACAGAAACTTCATGCAGCTGATTCACGACGACAGCCTCACCTTCAAAGAGGAT

ATCCAGAAAGCCCAGGTGTCCGGCCAGGGCGATTCTCTGCATGAGCACATTGCCAACCTGGC

CGGCTCTCCCGCCATTAAGAAAGGCATCCTGCAGACAGTGAAGGTGGTGGACGAGCTTGTGA

AAGTGATGGGCAGACACAAGCCCGAGAACATCGTGATCGAAATGGCCAGAGAGAACCAGACC

ACACAGAAGGGACAGAAGAACAGCCGCGAGAGAATGAAGCGGATCGAAGAGGGCATCAAAGA

GCTGGGCAGCCAGATCCTGAAAGAACACCCCGTGGAAAACACCCAGCTGCAGAACGAGAAGC

TGTACCTGTACTACCTGCAGAATGGACGGGATATGTACGTGGACCAAGAGCTGGACATCAAC

AGACTGTCCGACTACGATGTGGACCATATCGTGCCCCAGTCTTTTCTGAAGGACGACTCCAT

CGACAACAAGGTCCTGACCAGATCCGACAAGAATCGGGGCAAGAGCGACAACGTGCCCTCCG

AAGAGGTGGTCAAGAAGATGAAGAACTACTGGCGACAGCTGCTGAACGCCAAGCTGATTACC

CAGCGGAAGTTCGACAATCTGACCAAGGCCGAAAGAGGCGGCCTGAGCGAACTGGATAAGGC

CGGCTTCATCAAGAGACAGCTGGTGGAAACCCGGCAGATCACAAAGCACGTGGCACAGATTC

TGGACTCTCGGATGAACACTAAGTACGACGAGAACGACAAACTGATCCGCGAAGTGAAAGTC

ATCACCCTGAAGTCCAAGCTGGTGTCCGATTTCCGGAAGGATTTCCAGTTCTACAAAGTGCG

CGAGATCAACAACTACCATCACGCCCACGACGCCTACCTGAATGCCGTTGTTGGAACAGCCC

TGATCAAAAAGTACCCTAAGCTGGAAAGCGAGTTCGTGTACGGCGACTACAAGGTGTACGAC

```
GTGCGGAAGATGATCGCCAAGAGCGAGCAAGAGATTGGCAAGGCAACCGCCAAGTACTTCTT

CTACAGCAACATCATGAACTTTTTCAAGACAGAGATCACCCTCGCCAACGGCGAGATCAGAA

AGCGGCCTCTGATCGAGACAAACGGCGAAACCGGCGAGATTGTGTGGGATAAGGGCAGAGAC

TTTGCCACAGTGCGGAAAGTGCTGAGCATGCCCCAAGTGAATATCGTGAAGAAAACCGAGGT

GCAGACAGGCGGCTTCAGCAAAGAGTCTATCCTGCCTAAGCGGAACTCCGACAAGCTGATCG

CCAGAAAGAAGGACTGGGACCCCAAGAAGTACGGCGGCTTCGATTCTCCTACCGTGGCCTAT

AGCGTGCTGGTGGTGGCCAAAGTGGAAAAGGGCAAGTCCAAGAAACTCAAGAGCGTGAAAGA

GCTGCTGGGGATCACCATCATGGAAAGAAGCAGCTTCGAGAAGAATCCGATCGATTTCCTCG

AGGCCAAGGGCTACAAAGAAGTGAAAAAGGACCTGATCATCAAGCTCCCCAAGTACTCCCTG

TTCGAGCTGGAAAACGGCCGGAAGAGAATGCTGGCCTCTGCTGGCGAACTGCAGAAGGGAAA

CGAACTGGCCCTGCCTAGCAAATATGTGAACTTCCTGTACCTGGCCAGCCACTATGAGAAGC

TGAAGGGCAGCCCCGAGGACAATGAGCAAAAGCAGCTGTTTGTGGAACAGCACAAGCACTAC

CTGGACGAGATCATCGAGCAGATCAGCGAGTTTAGCAAGAGAGTGATTCTGGCCGACGCCAA

TCTGGACAAAGTGCTGTCCGCCTACAACAAGCACCGGGACAAGCCTATCAGAGAGCAGGCCG

AGAATATCATCCACCTGTTTACCCTGACCAACCTGGGAGCCCCTGCCGCCTTCAAGTACTTT

GACACCACCATCGACCGGAAGCGGTACACCTCCACCAAAGAGGTGCTGGACGCCACTCTGAT

CCACCAGTCTATCACCGGCCTGTACGAGACACGGATCGACCTGTCTCAACTCGGAGGCGACG

AAGGCGCCGATAAGAGAACCGCCGATGGCTCTGAGTTCGAGAGCCCCAAGAAAAAGCGCAAA

GTGTGA

ABE7.10_Cfa(GEP)-C_Split_T313C:
                                                        (SEQ ID NO: 148)
ATGGTCAAGATCATCAGCAGAAAGAGCCTGGGCACCCAGAACGTGTACGATATCGGAGTGGG

CGAGCCCCACAACTTTCTGCTCAAGAATGGCCTGGTGGCCAGCAACTGCAAGGCACCTCTGA

GCGCCTCTATGATCAAGAGATACGACGAGCACCACCAGGATCTGACCCTGCTGAAGGCCCTC

GTTAGACAGCAGCTGCCAGAGAAGTACAAAGAGATTTTCTTCGACCAGAGCAAGAACGGCTA

CGCCGGCTACATTGATGGCGGAGCCAGCCAAGAGGAATTCTACAAGTTCATCAAGCCCATCC

TCGAGAAGATGGACGGCACCGAGGAACTGCTGGTCAAGCTGAACAGAGAGGACCTGCTGAGA

AAGCAGAGAACCTTCGACAACGGCAGCATCCCTCACCAGATCCACCTGGGAGAACTGCACGC

CATTCTGCGGAGACAAGAGGACTTTTACCCATTCCTGAAGGACAACCGGGAAAAGATCGAGA

AAATCCTGACCTTCAGGATCCCCTACTACGTGGGACCACTGGCCAGAGGCAATAGCAGATTC

GCCTGGATGACCAGAAAGAGCGAGGAAACCATCACTCCCTGGAACTTCGAGGAAGTGGTGGA

CAAGGGCGCCAGCGCTCAGTCCTTCATCGAGCGGATGACCAACTTCGATAAGAACCTGCCTA

ACGAGAAGGTGCTGCCCAAGCACAGCCTGCTGTACGAGTACTTCACCGTGTACAACGAGCTG

ACCAAAGTGAAATACGTGACCGAGGGAATGAGAAAGCCCGCCTTTCTGAGCGGCGAGCAGAA

AAAGGCCATCGTGGATCTGCTGTTCAAGACCAACCGGAAAGTGACCGTGAAGCAGCTGAAAG

AGGACTACTTCAAGAAAATCGAGTGCTTCGACAGCGTCGAGATCTCCGGCGTGGAAGATCGG

TTCAATGCCAGCCTGGGCACATACCACGATCTGCTGAAAATTATCAAGGACAAGGACTTCCT

GGACAACGAAGAGAACGAGGACATCCTTGAGGACATCGTGCTGACACTGACCCTGTTTGAGG

ACAGAGAGATGATCGAGGAACGGCTGAAAACATACGCCCACCTGTTCGACGACAAAGTGATG

AAGCAACTGAAGCGGCGGAGATACACCGGCTGGGGCAGACTGTCTCGGAAGCTGATCAACGG

CATCCGGGATAAGCAGTCCGGCAAGACCATCCTGGACTTTCTGAAGTCCGACGGCTTCGCCA
```

-continued

ACAGAAACTTCATGCAGCTGATTCACGACGACAGCCTCACCTTCAAAGAGGATATCCAGAAA

GCCCAGGTGTCCGGCCAGGGCGATTCTCTGCATGAGCACATTGCCAACCTGGCCGGCTCTCC

CGCCATTAAGAAAGGCATCCTGCAGACAGTGAAGGTGGTGGACGAGCTTGTGAAAGTGATGG

GCAGACACAAGCCCGAGAACATCGTGATCGAAATGGCCAGAGAGAACCAGACCACACAGAAG

GGACAGAAGAACAGCCGCGAGAGAATGAAGCGGATCGAAGAGGGCATCAAAGAGCTGGGCAG

CCAGATCCTGAAAGAACACCCCGTGGAAAACACCCAGCTGCAGAACGAGAAGCTGTACCTGT

ACTACCTGCAGAATGGACGGGATATGTACGTGGACCAAGAGCTGGACATCAACAGACTGTCC

GACTACGATGTGGACCATATCGTGCCCCAGTCTTTTCTGAAGGACGACTCCATCGACAACAA

GGTCCTGACCAGATCCGACAAGAATCGGGGCAAGAGCGACAACGTGCCCTCCGAAGAGGTGG

TCAAGAAGATGAAGAACTACTGGCGACAGCTGCTGAACGCCAAGCTGATTACCCAGCGGAAG

TTCGACAATCTGACCAAGGCCGAAAGAGGCGGCCTGAGCGAACTGGATAAGGCCGGCTTCAT

CAAGAGACAGCTGGTGGAAACCCGGCAGATCACAAAGCACGTGGCACAGATTCTGGACTCTC

GGATGAACACTAAGTACGACGAGAACGACAAACTGATCCGCGAAGTGAAAGTCATCACCCTG

AAGTCCAAGCTGGTGTCCGATTTCCGGAAGGATTTCCAGTTCTACAAAGTGCGCGAGATCAA

CAACTACCATCACGCCCACGACGCCTACCTGAATGCCGTTGTTGGAACAGCCCTGATCAAAA

AGTACCCTAAGCTGGAAAGCGAGTTCGTGTACGGCGACTACAAGGTGTACGACGTGCGGAAG

ATGATCGCCAAGAGCGAGCAAGAGATTGGCAAGGCAACCGCCAAGTACTTCTTCTACAGCAA

CATCATGAACTTTTTCAAGACAGAGATCACCCTCGCCAACGGCGAGATCAGAAAGCGGCCTC

TGATCGAGACAAACGGCGAAACCGGCGAGATTGTGTGGGATAAGGGCAGAGACTTTGCCACA

GTGCGGAAAGTGCTGAGCATGCCCCAAGTGAATATCGTGAAGAAAACCGAGGTGCAGACAGG

CGGCTTCAGCAAAGAGTCTATCCTGCCTAAGCGGAACTCCGACAAGCTGATCGCCAGAAAGA

AGGACTGGGACCCCAAGAAGTACGGCGGCTTCGATTCTCCTACCGTGGCCTATAGCGTGCTG

GTGGTGGCCAAAGTGGAAAAGGGCAAGTCCAAGAAACTCAAGAGCGTGAAAGAGCTGCTGGG

GATCACCATCATGGAAAGAAGCAGCTTCGAGAAGAATCCGATCGATTTCCTCGAGGCCAAGG

GCTACAAAGAAGTGAAAAAGGACCTGATCATCAAGCTCCCCAAGTACTCCCTGTTCGAGCTG

GAAAACGGCCGGAAGAGAATGCTGGCCTCTGCTGGCGAACTGCAGAAGGGAAACGAACTGGC

CCTGCCTAGCAAATATGTGAACTTCCTGTACCTGGCCAGCCACTATGAGAAGCTGAAGGGCA

GCCCCGAGGACAATGAGCAAAAGCAGCTGTTTGTGGAACAGCACAAGCACTACCTGGACGAG

ATCATCGAGCAGATCAGCGAGTTTAGCAAGAGAGTGATTCTGGCCGACGCCAATCTGGACAA

AGTGCTGTCCGCCTACAACAAGCACCGGGACAAGCCTATCAGAGAGCAGGCCGAGAATATCA

TCCACCTGTTTACCCTGACCAACCTGGGAGCCCCTGCCGCCTTCAAGTACTTTGACACCACC

ATCGACCGGAAGCGGTACACCTCCACCAAAGAGGTGCTGGACGCCACTCTGATCCACCAGTC

TATCACCGGCCTGTACGAGACACGGATCGACCTGTCTCAACTCGGAGGCGACGAAGGCGCCG

ATAAGAGAACCGCCGATGGCTCTGAGTTCGAGAGCCCCAAGAAAAAGCGCAAAGTGTGA

ABE7.10_Cfa(GEP)-C_Split_S355C:

(SEQ ID NO: 149)

ATGGTCAAGATCATCAGCAGAAAGAGCCTGGGCACCCAGAACGTGTACGATATCGGAGTGGG

CGAGCCCCACAACTTTCTGCTCAAGAATGGCCTGGTGGCCAGCAACTGCAAGAACGGCTACG

CCGGCTACATTGATGGCGGAGCCAGCCAAGAGGAATTCTACAAGTTCATCAAGCCCATCCTC

GAGAAGATGGACGGCACCGAGGAACTGCTGGTCAAGCTGAACAGAGAGGACCTGCTGAGAAA

GCAGAGAACCTTCGACAACGGCAGCATCCCTCACCAGATCCACCTGGAGAACTGCACGCCA

TTCTGCGGAGACAAGAGGACTTTTACCCATTCCTGAAGGACAACCGGGAAAAGATCGAGAAA

-continued

```
ATCCTGACCTTCAGGATCCCCTACTACGTGGGACCACTGGCCAGAGGCAATAGCAGATTCGC

CTGGATGACCAGAAAGAGCGAGGAAACCATCACTCCCTGGAACTTCGAGGAAGTGGTGGACA

AGGGCGCCAGCGCTCAGTCCTTCATCGAGCGGATGACCAACTTCGATAAGAACCTGCCTAAC

GAGAAGGTGCTGCCCAAGCACAGCCTGCTGTACGAGTACTTCACCGTGTACAACGAGCTGAC

CAAAGTGAAATACGTGACCGAGGGAATGAGAAAGCCCGCCTTTCTGAGCGGCGAGCAGAAAA

AGGCCATCGTGGATCTGCTGTTCAAGACCAACCGGAAAGTGACCGTGAAGCAGCTGAAAGAG

GACTACTTCAAGAAAATCGAGTGCTTCGACAGCGTCGAGATCTCCGGCGTGGAAGATCGGTT

CAATGCCAGCCTGGGCACATACCACGATCTGCTGAAAATTATCAAGGACAAGGACTTCCTGG

ACAACGAAGAGAACGAGGACATCCTTGAGGACATCGTGCTGACACTGACCCTGTTTGAGGAC

AGAGAGATGATCGAGGAACGGCTGAAAACATACGCCCACCTGTTCGACGACAAAGTGATGAA

GCAACTGAAGCGGCGGAGATACACCGGCTGGGGCAGACTGTCTCGGAAGCTGATCAACGGCA

TCCGGGATAAGCAGTCCGGCAAGACCATCCTGGACTTTCTGAAGTCCGACGGCTTCGCCAAC

AGAAACTTCATGCAGCTGATTCACGACGACAGCCTCACCTTCAAAGAGGATATCCAGAAAGC

CCAGGTGTCCGGCCAGGGCGATTCTCTGCATGAGCACATTGCCAACCTGGCCGGCTCTCCCG

CCATTAAGAAAGGCATCCTGCAGACAGTGAAGGTGGTGGACGAGCTTGTGAAAGTGATGGGC

AGACACAAGCCCGAGAACATCGTGATCGAAATGGCCAGAGAGAACCAGACCACACAGAAGGG

ACAGAAGAACAGCCGCGAGAGAATGAAGCGGATCGAAGAGGGCATCAAAGAGCTGGGCAGCC

AGATCCTGAAAGAACACCCCGTGGAAAACACCCAGCTGCAGAACGAGAAGCTGTACCTGTAC

TACCTGCAGAATGGACGGGATATGTACGTGGACCAAGAGCTGGACATCAACAGACTGTCCGA

CTACGATGTGGACCATATCGTGCCCCAGTCTTTTCTGAAGGACGACTCCATCGACAACAAGG

TCCTGACCAGATCCGACAAGAATCGGGGCAAGAGCGACAACGTGCCCTCCGAAGAGGTGGTC

AAGAAGATGAAGAACTACTGGCGACAGCTGCTGAACGCCAAGCTGATTACCCAGCGGAAGTT

CGACAATCTGACCAAGGCCGAAAGAGGCGGCCTGAGCGAACTGGATAAGGCCGGCTTCATCA

AGAGACAGCTGGTGGAAACCCGGCAGATCACAAAGCACGTGGCACAGATTCTGGACTCTCGG

ATGAACACTAAGTACGACGAGAACGACAAACTGATCCGCGAAGTGAAAGTCATCACCCTGAA

GTCCAAGCTGGTGTCCGATTTCCGGAAGGATTTCCAGTTCTACAAAGTGCGCGAGATCAACA

ACTACCATCACGCCCACGACGCCTACCTGAATGCCGTTGTTGGAACAGCCCTGATCAAAAAG

TACCCTAAGCTGGAAAGCGAGTTCGTGTACGGCGACTACAAGGTGTACGACGTGCGGAAGAT

GATCGCCAAGAGCGAGCAAGAGATTGGCAAGGCAACCGCCAAGTACTTCTTCTACAGCAACA

TCATGAACTTTTTCAAGACAGAGATCACCCTCGCCAACGGCGAGATCAGAAAGCGGCCTCTG

ATCGAGACAAACGGCGAAACCGGCGAGATTGTGTGGGATAAGGGCAGAGACTTTGCCACAGT

GCGGAAAGTGCTGAGCATGCCCCAAGTGAATATCGTGAAGAAAACCGAGGTGCAGACAGGCG

GCTTCAGCAAAGAGTCTATCCTGCCTAAGCGGAACTCCGACAAGCTGATCGCCAGAAAGAAG

GACTGGGACCCCAAGAAGTACGGCGGCTTCGATTCTCCTACCGTGGCCTATAGCGTGCTGGT

GGTGGCCAAAGTGGAAAAGGGCAAGTCCAAGAAACTCAAGAGCGTGAAAGAGCTGCTGGGGA

TCACCATCATGGAAAGAAGCAGCTTCGAGAAGAATCCGATCGATTTCCTCGAGGCCAAGGGC

TACAAAGAAGTGAAAAAGGACCTGATCATCAAGCTCCCCAAGTACTCCCTGTTCGAGCTGGA

AAACGGCCGGAAGAGAATGCTGGCCTCTGCTGGCGAACTGCAGAAGGGAAACGAACTGGCCC

TGCCTAGCAAATATGTGAACTTCCTGTACCTGGCCAGCCACTATGAGAAGCTGAAGGGCAGC

CCCGAGGACAATGAGCAAAAGCAGCTGTTTGTGGAACAGCACAAGCACTACCTGGACGAGAT
```

-continued

CATCGAGCAGATCAGCGAGTTTAGCAAGAGAGTGATTCTGGCCGACGCCAATCTGGACAAAG

TGCTGTCCGCCTACAACAAGCACCGGGACAAGCCTATCAGAGAGCAGGCCGAGAATATCATC

CACCTGTTTACCCTGACCAACCTGGGAGCCCCTGCCGCCTTCAAGTACTTTGACACCACCAT

CGACCGGAAGCGGTACACCTCCACCAAAGAGGTGCTGGACGCCACTCTGATCCACCAGTCTA

TCACCGGCCTGTACGAGACACGGATCGACCTGTCTCAACTCGGAGGCGACGAAGGCGCCGAT

AAGAGAACCGCCGATGGCTCTGAGTTCGAGAGCCCCAAGAAAAAGCGCAAAGTGTGA

ABE7.10_Cfa(GEP)-C_Split_A456C:

(SEQ ID NO: 150)
ATGGTCAAGATCATCAGCAGAAAGAGCCTGGGCACCCAGAACGTGTACGATATCGGAGTGGG

CGAGCCCCACAACTTTCTGCTCAAGAATGGCCTGGTGGCCAGCAACTGCAGAGGCAATAGCA

GATTCGCCTGGATGACCAGAAAGAGCGAGGAAACCATCACTCCCTGGAACTTCGAGGAAGTG

GTGGACAAGGGCGCCAGCGCTCAGTCCTTCATCGAGCGGATGACCAACTTCGATAAGAACCT

GCCTAACGAGAAGGTGCTGCCCAAGCACAGCCTGCTGTACGAGTACTTCACCGTGTACAACG

AGCTGACCAAAGTGAAATACGTGACCGAGGGAATGAGAAAGCCCGCCTTTCTGAGCGGCGAG

CAGAAAAAGGCCATCGTGGATCTGCTGTTCAAGACCAACCGGAAAGTGACCGTGAAGCAGCT

GAAAGAGGACTACTTCAAGAAAATCGAGTGCTTCGACAGCGTCGAGATCTCCGGCGTGGAAG

ATCGGTTCAATGCCAGCCTGGGCACATACCACGATCTGCTGAAAATTATCAAGGACAAGGAC

TTCCTGGACAACGAAGAGAACGAGGACATCCTTGAGGACATCGTGCTGACACTGACCCTGTT

TGAGGACAGAGAGATGATCGAGGAACGGCTGAAAACATACGCCCACCTGTTCGACGACAAAG

TGATGAAGCAACTGAAGCGGCGGAGATACACCGGCTGGGGCAGACTGTCTCGGAAGCTGATC

AACGGCATCCGGGATAAGCAGTCCGGCAAGACCATCCTGGACTTTCTGAAGTCCGACGGCTT

CGCCAACAGAAACTTCATGCAGCTGATTCACGACGACAGCCTCACCTTCAAAGAGGATATCC

AGAAAGCCCAGGTGTCCGGCCAGGGCGATTCTCTGCATGAGCACATTGCCAACCTGGCCGGC

TCTCCCGCCATTAAGAAAGGCATCCTGCAGACAGTGAAGGTGGTGGACGAGCTTGTGAAAGT

GATGGGCAGACACAAGCCCGAGAACATCGTGATCGAAATGGCCAGAGAGAACCAGACCACAC

AGAAGGGACAGAAGAACAGCCGCGAGAGAATGAAGCGGATCGAAGAGGGCATCAAAGAGCTG

GGCAGCCAGATCCTGAAAGAACACCCCGTGGAAAACACCCAGCTGCAGAACGAGAAGCTGTA

CCTGTACTACCTGCAGAATGGACGGGATATGTACGTGGACCAAGAGCTGGACATCAACAGAC

TGTCCGACTACGATGTGGACCATATCGTGCCCCAGTCTTTTCTGAAGGACGACTCCATCGAC

AACAAGGTCCTGACCAGATCCGACAAGAATCGGGGCAAGAGCGACAACGTGCCCTCCGAAGA

GGTGGTCAAGAAGATGAAGAACTACTGGCGACAGCTGCTGAACGCCAAGCTGATTACCCAGC

GGAAGTTCGACAATCTGACCAAGGCCGAAAGAGGCGGCCTGAGCGAACTGGATAAGGCCGGC

TTCATCAAGAGACAGCTGGTGGAAACCCGGCAGATCACAAAGCACGTGGCACAGATTCTGGA

CTCTCGGATGAACACTAAGTACGACGAGAACGACAAACTGATCCGCGAAGTGAAAGTCATCA

CCCTGAAGTCCAAGCTGGTGTCCGATTTCCGGAAGGATTTCCAGTTCTACAAAGTGCGCGAG

ATCAACAACTACCATCACGCCCACGACGCCTACCTGAATGCCGTTGTTGGAACAGCCCTGAT

CAAAAAGTACCCTAAGCTGGAAAGCGAGTTCGTGTACGGCGACTACAAGGTGTACGACGTGC

GGAAGATGATCGCCAAGAGCGAGCAAGAGATTGGCAAGGCAACCGCCAAGTACTTCTTCTAC

AGCAACATCATGAACTTTTTCAAGACAGAGATCACCCTCGCCAACGGCGAGATCAGAAAGCG

GCCTCTGATCGAGACAAACGGCGAAACCGGCGAGATTGTGTGGGATAAGGGCAGAGACTTTG

CCACAGTGCGGAAAGTGCTGAGCATGCCCCAAGTGAATATCGTGAAGAAAACCGAGGTGCAG

ACAGGCGGCTTCAGCAAAGAGTCTATCCTGCCTAAGCGGAACTCCGACAAGCTGATCGCCAG

```
AAAGAAGGACTGGGACCCCAAGAAGTACGGCGGCTTCGATTCTCCTACCGTGGCCTATAGCG

TGCTGGTGGTGGCCAAAGTGGAAAAGGGCAAGTCCAAGAAACTCAAGAGCGTGAAAGAGCTG

CTGGGGATCACCATCATGGAAAGAAGCAGCTTCGAGAAGAATCCGATCGATTTCCTCGAGGC

CAAGGGCTACAAAGAAGTGAAAAAGGACCTGATCATCAAGCTCCCCAAGTACTCCCTGTTCG

AGCTGGAAAACGGCCGGAAGAGAATGCTGGCCTCTGCTGGCGAACTGCAGAAGGGAAACGAA

CTGGCCCTGCCTAGCAAATATGTGAACTTCCTGTACCTGGCCAGCCACTATGAGAAGCTGAA

GGGCAGCCCCGAGGACAATGAGCAAAAGCAGCTGTTTGTGGAACAGCACAAGCACTACCTGG

ACGAGATCATCGAGCAGATCAGCGAGTTTAGCAAGAGAGTGATTCTGGCCGACGCCAATCTG

GACAAAGTGCTGTCCGCCTACAACAAGCACCGGGACAAGCCTATCAGAGAGCAGGCCGAGAA

TATCATCCACCTGTTTACCCTGACCAACCTGGGAGCCCCTGCCGCCTTCAAGTACTTTGACA

CCACCATCGACCGGAAGCGGTACACCTCCACCAAAGAGGTGCTGGACGCCACTCTGATCCAC

CAGTCTATCACCGGCCTGTACGAGACACGGATCGACCTGTCTCAACTCGGAGGCGACGAAGG

CGCCGATAAGAGAACCGCCGATGGCTCTGAGTTCGAGAGCCCCAAGAAAAAGCGCAAAGTGT

GA
```

ABE7.10_Cfa(GEP)-C_Split_S460C:
(SEQ ID NO: 151)

```
ATGGTCAAGATCATCAGCAGAAAGAGCCTGGGCACCCAGAACGTGTACGATATCGGAGTGGG

CGAGCCCCACAACTTTCTGCTCAAGAATGGCCTGGTGGCCAGCAACTGCAGATTCGCCTGGA

TGACCAGAAAGAGCGAGGAAACCATCACTCCCTGGAACTTCGAGGAAGTGGTGGACAAGGGC

GCCAGCGCTCAGTCCTTCATCGAGCGGATGACCAACTTCGATAAGAACCTGCCTAACGAGAA

GGTGCTGCCCAAGCACAGCCTGCTGTACGAGTACTTCACCGTGTACAACGAGCTGACCAAAG

TGAAATACGTGACCGAGGGAATGAGAAAGCCCGCCTTTCTGAGCGGCGAGCAGAAAAAGGCC

ATCGTGGATCTGCTGTTCAAGACCAACCGGAAAGTGACCGTGAAGCAGCTGAAAGAGGACTA

CTTCAAGAAAATCGAGTGCTTCGACAGCGTCGAGATCTCCGGCGTGGAAGATCGGTTCAATG

CCAGCCTGGGCACATACCACGATCTGCTGAAAATTATCAAGGACAAGGACTTCCTGGACAAC

GAAGAGAACGAGGACATCCTTGAGGACATCGTGCTGACACTGACCCTGTTTGAGGACAGAGA

GATGATCGAGGAACGGCTGAAAACATACGCCCACCTGTTCGACGACAAAGTGATGAAGCAAC

TGAAGCGGCGGAGATACACCGGCTGGGGCAGACTGTCTCGGAAGCTGATCAACGGCATCCGG

GATAAGCAGTCCGGCAAGACCATCCTGGACTTTCTGAAGTCCGACGGCTTCGCCAACAGAAA

CTTCATGCAGCTGATTCACGACGACAGCCTCACCTTCAAAGAGGATATCCAGAAAGCCCAGG

TGTCCGGCCAGGGCGATTCTCTGCATGAGCACATTGCCAACCTGGCCGGCTCTCCCGCCATT

AAGAAAGGCATCCTGCAGACAGTGAAGGTGGTGGACGAGCTTGTGAAAGTGATGGGCAGACA

CAAGCCCGAGAACATCGTGATCGAAATGGCCAGAGAGAACCAGACCACACAGAAGGGACAGA

AGAACAGCCGCGAGAGAATGAAGCGGATCGAAGAGGGCATCAAAGAGCTGGGCAGCCAGATC

CTGAAAGAACACCCCGTGGAAAACACCCAGCTGCAGAACGAGAAGCTGTACCTGTACTACCT

GCAGAATGGACGGGATATGTACGTGGACCAAGAGCTGGACATCAACAGACTGTCCGACTACG

ATGTGGACCATATCGTGCCCCAGTCTTTTCTGAAGGACGACTCCATCGACAACAAGGTCCTG

ACCAGATCCGACAAGAATCGGGGCAAGAGCGACAACGTGCCCTCCGAAGAGGTGGTCAAGAA

GATGAAGAACTACTGGCGACAGCTGCTGAACGCCAAGCTGATTACCCAGCGGAAGTTCGACA

ATCTGACCAAGGCCGAAAGAGGCGGCCTGAGCGAACTGGATAAGGCCGGCTTCATCAAGAGA

CAGCTGGTGGAAACCCGGCAGATCACAAAGCACGTGGCACAGATTCTGGACTCTCGGATGAA
```

```
CACTAAGTACGACGAGAACGACAAACTGATCCGCGAAGTGAAAGTCATCACCCTGAAGTCCA

AGCTGGTGTCCGATTTCCGGAAGGATTTCCAGTTCTACAAAGTGCGCGAGATCAACAACTAC

CATCACGCCCACGACGCCTACCTGAATGCCGTTGTTGGAACAGCCCTGATCAAAAAGTACCC

TAAGCTGGAAAGCGAGTTCGTGTACGGCGACTACAAGGTGTACGACGTGCGGAAGATGATCG

CCAAGAGCGAGCAAGAGATTGGCAAGGCAACCGCCAAGTACTTCTTCTACAGCAACATCATG

AACTTTTTCAAGACAGAGATCACCCTCGCCAACGGCGAGATCAGAAAGCGGCCTCTGATCGA

GACAAACGGCGAAACCGGCGAGATTGTGTGGGATAAGGGCAGAGACTTTGCCACAGTGCGGA

AAGTGCTGAGCATGCCCCAAGTGAATATCGTGAAGAAAACCGAGGTGCAGACAGGCGGCTTC

AGCAAAGAGTCTATCCTGCCTAAGCGGAACTCCGACAAGCTGATCGCCAGAAAGAAGGACTG

GGACCCCAAGAAGTACGGCGGCTTCGATTCTCCTACCGTGGCCTATAGCGTGCTGGTGGTGG

CCAAAGTGGAAAAGGGCAAGTCCAAGAAACTCAAGAGCGTGAAAGAGCTGCTGGGGATCACC

ATCATGGAAAGAAGCAGCTTCGAGAAGAATCCGATCGATTTCCTCGAGGCCAAGGGCTACAA

AGAAGTGAAAAAGGACCTGATCATCAAGCTCCCCAAGTACTCCCTGTTCGAGCTGGAAAACG

GCCGGAAGAGAATGCTGGCCTCTGCTGGCGAACTGCAGAAGGGAAACGAACTGGCCCTGCCT

AGCAAATATGTGAACTTCCTGTACCTGGCCAGCCACTATGAGAAGCTGAAGGGCAGCCCCGA

GGACAATGAGCAAAAGCAGCTGTTTGTGGAACAGCACAAGCACTACCTGGACGAGATCATCG

AGCAGATCAGCGAGTTTAGCAAGAGAGTGATTCTGGCCGACGCCAATCTGGACAAAGTGCTG

TCCGCCTACAACAAGCACCGGGACAAGCCTATCAGAGAGCAGGCCGAGAATATCATCCACCT

GTTTACCCTGACCAACCTGGGAGCCCCTGCCGCCTTCAAGTACTTTGACACCACCATCGACC

GGAAGCGGTACACCTCCACCAAAGAGGTGCTGGACGCCACTCTGATCCACCAGTCTATCACC

GGCCTGTACGAGACACGGATCGACCTGTCTCAACTCGGAGGCGACGAAGGCGCCGATAAGAG

AACCGCCGATGGCTCTGAGTTCGAGAGCCCCAAGAAAAAGCGCAAAGTGTGA
```

ABE7.10_Cfa(GEP)-C_Split_A463C:
(SEQ ID NO: 152)

```
ATGGTCAAGATCATCAGCAGAAAGAGCCTGGGCACCCAGAACGTGTACGATATCGGAGTGGG

CGAGCCCCACAACTTTCTGCTCAAGAATGGCCTGGTGGCCAGCAACTGCTGGATGACCAGAA

AGAGCGAGGAAACCATCACTCCCTGGAACTTCGAGGAAGTGGTGGACAAGGGCGCCAGCGCT

CAGTCCTTCATCGAGCGGATGACCAACTTCGATAAGAACCTGCCTAACGAGAAGGTGCTGCC

CAAGCACAGCCTGCTGTACGAGTACTTCACCGTGTACAACGAGCTGACCAAAGTGAAATACG

TGACCGAGGGAATGAGAAAGCCCGCCTTTCTGAGCGGCGAGCAGAAAAAGGCCATCGTGGAT

CTGCTGTTCAAGACCAACCGGAAAGTGACCGTGAAGCAGCTGAAAGAGGACTACTTCAAGAA

AATCGAGTGCTTCGACAGCGTCGAGATCTCCGGCGTGGAAGATCGGTTCAATGCCAGCCTGG

GCACATACCACGATCTGCTGAAAATTATCAAGGACAAGGACTTCCTGGACAACGAAGAGAAC

GAGGACATCCTTGAGGACATCGTGCTGACACTGACCCTGTTTGAGGACAGAGAGATGATCGA

GGAACGGCTGAAAACATACGCCCACCTGTTCGACGACAAAGTGATGAAGCAACTGAAGCGGC

GGGAGATACACCGGCTGGGGCAGACTGTCTCGGAAGCTGATCAACGGCATCCGGGATAAGCAG

TCCGGCAAGACCATCCTGGACTTTCTGAAGTCCGACGGCTTCGCCAACAGAAACTTCATGCA

GCTGATTCACGACGACAGCCTCACCTTCAAAGAGGATATCCAGAAAGCCCAGGTGTCCGGCC

AGGGCGATTCTCTGCATGAGCACATTGCCAACCTGGCCGGCTCTCCCGCCATTAAGAAAGGC

ATCCTGCAGACAGTGAAGGTGGTGGACGAGCTTGTGAAAGTGATGGGCAGACACAAGCCCGA

GAACATCGTGATCGAAATGGCCAGAGAGAACCAGACCACACAGAAGGGACAGAAGAACAGCC

GCGAGAGAATGAAGCGGATCGAAGAGGGCATCAAAGAGCTGGGCAGCCAGATCCTGAAAGAA
```

-continued

```
CACCCCGTGGAAAACACCCAGCTGCAGAACGAGAAGCTGTACCTGTACTACCTGCAGAATGG

ACGGGATATGTACGTGGACCAAGAGCTGGACATCAACAGACTGTCCGACTACGATGTGGACC

ATATCGTGCCCCAGTCTTTTCTGAAGGACGACTCCATCGACAACAAGGTCCTGACCAGATCC

GACAAGAATCGGGGCAAGAGCGACAACGTGCCCTCCGAAGAGGTGGTCAAGAAGATGAAGAA

CTACTGGCGACAGCTGCTGAACGCCAAGCTGATTACCCAGCGGAAGTTCGACAATCTGACCA

AGGCCGAAAGAGGCGGCCTGAGCGAACTGGATAAGGCCGGCTTCATCAAGAGACAGCTGGTG

GAAACCCGGCAGATCACAAAGCACGTGGCACAGATTCTGGACTCTCGGATGAACACTAAGTA

CGACGAGAACGACAAACTGATCCGCGAAGTGAAAGTCATCACCCTGAAGTCCAAGCTGGTGT

CCGATTTCCGGAAGGATTTCCAGTTCTACAAAGTGCGCGAGATCAACAACTACCATCACGCC

CACGACGCCTACCTGAATGCCGTTGTTGGAACAGCCCTGATCAAAAAGTACCCTAAGCTGGA

AAGCGAGTTCGTGTACGGCGACTACAAGGTGTACGACGTGCGGAAGATGATCGCCAAGAGCG

AGCAAGAGATTGGCAAGGCAACCGCCAAGTACTTCTTCTACAGCAACATCATGAACTTTTTC

AAGACAGAGATCACCCTCGCCAACGGCGAGATCAGAAAGCGGCCTCTGATCGAGACAAACGG

CGAAACCGGCGAGATTGTGTGGGATAAGGGCAGAGACTTTGCCACAGTGCGGAAAGTGCTGA

GCATGCCCCAAGTGAATATCGTGAAGAAAACCGAGGTGCAGACAGGCGGCTTCAGCAAAGAG

TCTATCCTGCCTAAGCGGAACTCCGACAAGCTGATCGCCAGAAAGAAGGACTGGGACCCCAA

GAAGTACGGCGGCTTCGATTCTCCTACCGTGGCCTATAGCGTGCTGGTGGTGGCCAAAGTGG

AAAAGGGCAAGTCCAAGAAACTCAAGAGCGTGAAAGAGCTGCTGGGGATCACCATCATGGAA

AGAAGCAGCTTCGAGAAGAATCCGATCGATTTCCTCGAGGCCAAGGGCTACAAAGAAGTGAA

AAAGGACCTGATCATCAAGCTCCCCAAGTACTCCCTGTTCGAGCTGGAAAACGGCCGGAAGA

GAATGCTGGCCTCTGCTGGCGAACTGCAGAAGGGAAACGAACTGGCCCTGCCTAGCAAATAT

GTGAACTTCCTGTACCTGGCCAGCCACTATGAGAAGCTGAAGGGCAGCCCCGAGGACAATGA

GCAAAAGCAGCTGTTTGTGGAACAGCACAAGCACTACCTGGACGAGATCATCGAGCAGATCA

GCGAGTTTAGCAAGAGAGTGATTCTGGCCGACGCCAATCTGGACAAAGTGCTGTCCGCCTAC

AACAAGCACCGGGACAAGCCTATCAGAGAGCAGGCCGAGAATATCATCCACCTGTTTACCCT

GACCAACCTGGGAGCCCCTGCCGCCTTCAAGTACTTTGACACCACCATCGACCGGAAGCGGT

ACACCTCCACCAAAGAGGTGCTGGACGCCACTCTGATCCACCAGTCTATCACCGGCCTGTAC

GAGACACGGATCGACCTGTCTCAACTCGGAGGCGACGAAGGCGCCGATAAGAGAACCGCCGA

TGGCTCTGAGTTCGAGAGCCCCAAGAAAAAGCGCAAAGTGTGA
```

ABE7.10_Cfa(GEP)-C_Split_T446C:

(SEQ ID NO: 153)
```
ATGGTCAAGATCATCAGCAGAAAGAGCCTGGGCACCCAGAACGTGTACGATATCGGAGTGGG

CGAGCCCCACAACTTTCTGCTCAAGAATGGCCTGGTGGCCAGCAACTGCAGAAAGAGCGAGG

AAACCATCACTCCCTGGAACTTCGAGGAAGTGGTGGACAAGGGCGCCAGCGCTCAGTCCTTC

ATCGAGCGGATGACCAACTTCGATAAGAACCTGCCTAACGAGAAGGTGCTGCCCAAGCACAG

CCTGCTGTACGAGTACTTCACCGTGTACAACGAGCTGACCAAAGTGAAATACGTGACCGAGG

GAATGAGAAAGCCCGCCTTTCTGAGCGGCGAGCAGAAAAAGGCCATCGTGGATCTGCTGTTC

AAGACCAACCGGAAAGTGACCGTGAAGCAGCTGAAAGAGGACTACTTCAAGAAAATCGAGTG

CTTCGACAGCGTCGAGATCTCCGGCGTGGAAGATCGGTTCAATGCCAGCCTGGGCACATACC

ACGATCTGCTGAAAATTATCAAGGACAAGGACTTCCTGGACAACGAAGAACGAGGACATC

CTTGAGGACATCGTGCTGACACTGACCCTGTTTGAGGACAGAGAGATGATCGAGGAACGGCT
```

-continued

```
GAAAACATACGCCCACCTGTTCGACGACAAAGTGATGAAGCAACTGAAGCGGCGGAGATACA
CCGGCTGGGGCAGACTGTCTCGGAAGCTGATCAACGGCATCCGGGATAAGCAGTCCGGCAAG
ACCATCCTGGACTTTCTGAAGTCCGACGGCTTCGCCAACAGAAACTTCATGCAGCTGATTCA
CGACGACAGCCTCACCTTCAAAGAGGATATCCAGAAAGCCCAGGTGTCCGGCCAGGGCGATT
CTCTGCATGAGCACATTGCCAACCTGGCCGGCTCTCCCGCCATTAAGAAAGGCATCCTGCAG
ACAGTGAAGGTGGTGGACGAGCTTGTGAAAGTGATGGGCAGACACAAGCCCGAGAACATCGT
GATCGAAATGGCCAGAGAGAACCAGACCACACAGAAGGGACAGAAGAACAGCCGCGAGAGAA
TGAAGCGGATCGAAGAGGGCATCAAAGAGCTGGGCAGCCAGATCCTGAAAGAACACCCCGTG
GAAAACACCCAGCTGCAGAACGAGAAGCTGTACCTGTACTACCTGCAGAATGGACGGGATAT
GTACGTGGACCAAGAGCTGGACATCAACAGACTGTCCGACTACGATGTGGACCATATCGTGC
CCCAGTCTTTTCTGAAGGACGACTCCATCGACAACAAGGTCCTGACCAGATCCGACAAGAAT
CGGGGCAAGAGCGACAACGTGCCCTCCGAAGAGGTGGTCAAGAAGATGAAGAACTACTGGCG
ACAGCTGCTGAACGCCAAGCTGATTACCCAGCGGAAGTTCGACAATCTGACCAAGGCCGAAA
GAGGCGGCCTGAGCGAACTGGATAAGGCCGGCTTCATCAAGAGACAGCTGGTGGAAACCCGG
CAGATCACAAAGCACGTGGCACAGATTCTGGACTCTCGGATGAACACTAAGTACGACGAGAA
CGACAAACTGATCCGCGAAGTGAAAGTCATCACCCTGAAGTCCAAGCTGGTGTCCGATTTCC
GGAAGGATTTCCAGTTCTACAAAGTGCGCGAGATCAACAACTACCATCACGCCCACGACGCC
TACCTGAATGCCGTTGTTGGAACAGCCCTGATCAAAAAGTACCCTAAGCTGGAAAGCGAGTT
CGTGTACGGCGACTACAAGGTGTACGACGTGCGGAAGATGATCGCCAAGAGCGAGCAAGAGA
TTGGCAAGGCAACCGCCAAGTACTTCTTCTACAGCAACATCATGAACTTTTTCAAGACAGAG
ATCACCCTCGCCAACGGCGAGATCAGAAAGCGGCCTCTGATCGAGACAAACGGCGAAACCGG
CGAGATTGTGTGGGATAAGGGCAGAGACTTTGCCACAGTGCGGAAAGTGCTGAGCATGCCCC
AAGTGAATATCGTGAAGAAAACCGAGGTGCAGACAGGCGGCTTCAGCAAAGAGTCTATCCTG
CCTAAGCGGAACTCCGACAAGCTGATCGCCAGAAAGAAGGACTGGGACCCCAAGAAGTACGG
CGGCTTCGATTCTCCTACCGTGGCCTATAGCGTGCTGGTGGTGGCCAAAGTGGAAAAGGGCA
AGTCCAAGAAACTCAAGAGCGTGAAAGAGCTGCTGGGGATCACCATCATGGAAGAAGCAGC
TTCGAGAAGAATCCGATCGATTTCCTCGAGGCCAAGGGCTACAAAGAAGTGAAAAAGGACCT
GATCATCAAGCTCCCCAAGTACTCCCTGTTCGAGCTGGAAAACGGCCGGAAGAGAATGCTGG
CCTCTGCTGGCGAACTGCAGAAGGGAAACGAACTGGCCCTGCCTAGCAAATATGTGAACTTC
CTGTACCTGGCCAGCCACTATGAGAAGCTGAAGGGCAGCCCCGAGGACAATGAGCAAAAGCA
GCTGTTTGTGGAACAGCACAAGCACTACCTGGACGAGATCATCGAGCAGATCAGCGAGTTTA
GCAAGAGAGTGATTCTGGCCGACGCCAATCTGGACAAAGTGCTGTCCGCCTACAACAAGCAC
CGGGACAAGCCTATCAGAGAGCAGGCCGAGAATATCATCCACCTGTTTACCCTGACCAACCT
GGGAGCCCCTGCCGCCTTCAAGTACTTTGACACCACCATCGACCGGAAGCGGTACACCTCCA
CCAAAGAGGTGCTGGACGCCACTCTGATCCACCAGTCTATCACCGGCCTGTACGAGACACGG
ATCGACCTGTCTCAACTCGGAGGCGACGAAGGCGCCGATAAGAGAACCGCCGATGGCTCTGA
GTTCGAGAGCCCCAAGAAAAAGCGCAAAGTGTGA
```

ABE7.10_Cfa(GEP)-C_Split_T469C:

(SEQ ID NO: 154)

```
ATGGTCAAGATCATCAGCAGAAAGAGCCTGGGCACCCAGAACGTGTACGATATCGGAGTGGG
CGAGCCCCACAACTTTCTGCTCAAGAATGGCCTGGTGGCCAGCAACTGCGAGGAAACCATCA
CTCCCTGGAACTTCGAGGAAGTGGTGGACAAGGGCGCCAGCGCTCAGTCCTTCATCGAGCGG
```

```
-continued
ATGACCAACTTCGATAAGAACCTGCCTAACGAGAAGGTGCTGCCCAAGCACAGCCTGCTGTA
CGAGTACTTCACCGTGTACAACGAGCTGACCAAAGTGAAATACGTGACCGAGGGAATGAGAA
AGCCCGCCTTTCTGAGCGGCGAGCAGAAAAAGGCCATCGTGGATCTGCTGTTCAAGACCAAC
CGGAAAGTGACCGTGAAGCAGCTGAAAGAGGACTACTTCAAGAAAATCGAGTGCTTCGACAG
CGTCGAGATCTCCGGCGTGGAAGATCGGTTCAATGCCAGCCTGGGCACATACCACGATCTGC
TGAAAATTATCAAGGACAAGGACTTCCTGGACAACGAAGAGAACGAGGACATCCTTGAGGAC
ATCGTGCTGACACTGACCCTGTTTGAGGACAGAGAGATGATCGAGGAACGGCTGAAAACATA
CGCCCACCTGTTCGACGACAAAGTGATGAAGCAACTGAAGCGGCGGAGATACACCGGCTGGG
GCAGACTGTCTCGGAAGCTGATCAACGGCATCCGGGATAAGCAGTCCGGCAAGACCATCCTG
GACTTTCTGAAGTCCGACGGCTTCGCCAACAGAAACTTCATGCAGCTGATTCACGACGACAG
CCTCACCTTCAAAGAGGATATCCAGAAAGCCCAGGTGTCCGGCCAGGGCGATTCTCTGCATG
AGCACATTGCCAACCTGGCCGGCTCTCCCGCCATTAAGAAAGGCATCCTGCAGACAGTGAAG
GTGGTGGACGAGCTTGTGAAAGTGATGGGCAGACACAAGCCCGAGAACATCGTGATCGAAAT
GGCCAGAGAGAACCAGACCACACAGAAGGGACAGAAGAACAGCCGCGAGAGAATGAAGCGGA
TCGAAGAGGGCATCAAAGAGCTGGGCAGCCAGATCCTGAAAGAACACCCCGTGGAAAACACC
CAGCTGCAGAACGAGAAGCTGTACCTGTACTACCTGCAGAATGGACGGGATATGTACGTGGA
CCAAGAGCTGGACATCAACAGACTGTCCGACTACGATGTGGACCATATCGTGCCCCAGTCTT
TTCTGAAGGACGACTCCATCGACAACAAGGTCCTGACCAGATCCGACAAGAATCGGGGCAAG
AGCGACAACGTGCCCTCCGAAGAGGTGGTCAAGAAGATGAAGAACTACTGGCGACAGCTGCT
GAACGCCAAGCTGATTACCCAGCGGAAGTTCGACAATCTGACCAAGGCCGAAAGAGGCGGCC
TGAGCGAACTGGATAAGGCCGGCTTCATCAAGAGACAGCTGGTGGAAACCCGGCAGATCACA
AAGCACGTGGCACAGATTCTGGACTCTCGGATGAACACTAAGTACGACGAGAACGACAAACT
GATCCGCGAAGTGAAAGTCATCACCCTGAAGTCCAAGCTGGTGTCCGATTTCCGGAAGGATT
TCCAGTTCTACAAAGTGCGCGAGATCAACAACTACCATCACGCCCACGACGCCTACCTGAAT
GCCGTTGTTGGAACAGCCCTGATCAAAAAGTACCCTAAGCTGGAAAGCGAGTTCGTGTACGG
CGACTACAAGGTGTACGACGTGCGGAAGATGATCGCCAAGAGCGAGCAAGAGATTGGCAAGG
CAACCGCCAAGTACTTCTTCTACAGCAACATCATGAACTTTTTCAAGACAGAGATCACCCTC
GCCAACGGCGAGATCAGAAAGCGGCCTCTGATCGAGACAAACGGCGAAACCGGCGAGATTGT
GTGGGATAAGGGCAGAGACTTTGCCACAGTGCGGAAAGTGCTGAGCATGCCCCAAGTGAATA
TCGTGAAGAAAACCGAGGTGCAGACAGGCGGCTTCAGCAAAGAGTCTATCCTGCCTAAGCGG
AACTCCGACAAGCTGATCGCCAGAAAGAAGGACTGGGACCCCAAGAAGTACGGCGGCTTCGA
TTCTCCTACCGTGGCCTATAGCGTGCTGGTGGTGGCCAAAGTGGAAAAGGGCAAGTCCAAGA
AACTCAAGAGCGTGAAAGAGCTGCTGGGGATCACCATCATGGAAAGAAGCAGCTTCGAGAAG
AATCCGATCGATTTCCTCGAGGCCAAGGGCTACAAAGAAGTGAAAAAGGACCTGATCATCAA
GCTCCCCAAGTACTCCCTGTTCGAGCTGGAAAACGGCCGGAAGAGAATGCTGGCCTCTGCTG
GCGAACTGCAGAAGGGAAACGAACTGGCCCTGCCTAGCAAATATGTGAACTTCCTGTACCTG
GCCAGCCACTATGAGAAGCTGAAGGGCAGCCCCGAGGACAATGAGCAAAAGCAGCTGTTTGT
GGAACAGCACAAGCACTACCTGGACGAGATCATCGAGCAGATCAGCGAGTTTAGCAAGAGAG
TGATTCTGGCCGACGCCAATCTGGACAAAGTGCTGTCCGCCTACAACAAGCACCGGGACAAG
CCTATCAGAGAGCAGGCCGAGAATATCATCCACCTGTTTACCCTGACCAACCTGGGAGCCCC
```

-continued

TGCCGCCTTCAAGTACTTTGACACCACCATCGACCGGAAGCGGTACACCTCCACCAAAGAGG

TGCTGGACGCCACTCTGATCCACCAGTCTATCACCGGCCTGTACGAGACACGGATCGACCTG

TCTCAACTCGGAGGCGACGAAGGCGCCGATAAGAGAACCGCCGATGGCTCTGAGTTCGAGAG

CCCCAAGAAAAAGCGCAAAGTGTGA

ABE7.10_Cfa(GEP)-C_Split_T472C:

(SEQ ID NO: 155)
ATGGTCAAGATCATCAGCAGAAAGAGCCTGGGCACCCAGAACGTGTACGATATCGGAGTGGG

CGAGCCCCACAACTTTCTGCTCAAGAATGGCCTGGTGGCCAGCAACTGCATCACTCCCTGGA

ACTTCGAGGAAGTGGTGGACAAGGGCGCCAGCGCTCAGTCCTTCATCGAGCGGATGACCAAC

TTCGATAAGAACCTGCCTAACGAGAAGGTGCTGCCCAAGCACAGCCTGCTGTACGAGTACTT

CACCGTGTACAACGAGCTGACCAAAGTGAAATACGTGACCGAGGGAATGAGAAAGCCCGCCT

TTCTGAGCGGCGAGCAGAAAAAGGCCATCGTGGATCTGCTGTTCAAGACCAACCGGAAGTG

ACCGTGAAGCAGCTGAAAGAGGACTACTTCAAGAAAATCGAGTGCTTCGACAGCGTCGAGAT

CTCCGGCGTGGAAGATCGGTTCAATGCCAGCCTGGGCACATACCACGATCTGCTGAAAATTA

TCAAGGACAAGGACTTCCTGGACAACGAAGAGAACGAGGACATCCTTGAGGACATCGTGCTG

ACACTGACCCTGTTTGAGGACAGAGAGATGATCGAGGAACGGCTGAAAACATACGCCCACCT

GTTCGACGACAAAGTGATGAAGCAACTGAAGCGGCGGAGATACACCGGCTGGGGCAGACTGT

CTCGGAAGCTGATCAACGGCATCCGGGATAAGCAGTCCGGCAAGACCATCCTGGACTTTCTG

AAGTCCGACGGCTTCGCCAACAGAAACTTCATGCAGCTGATTCACGACGACAGCCTCACCTT

CAAAGAGGATATCCAGAAAGCCCAGGTGTCCGGCCAGGGCGATTCTCTGCATGAGCACATTG

CCAACCTGGCCGGCTCTCCCGCCATTAAGAAAGGCATCCTGCAGACAGTGAAGGTGGTGGAC

GAGCTTGTGAAAGTGATGGGCAGACACAAGCCCGAGAACATCGTGATCGAAATGGCCAGAGA

GAACCAGACCACACAGAAGGGACAGAAGAACAGCCGCGAGAGAATGAAGCGGATCGAAGAGG

GCATCAAAGAGCTGGGCAGCCAGATCCTGAAAGAACACCCCGTGGAAAACACCCAGCTGCAG

AACGAGAAGCTGTACCTGTACTACCTGCAGAATGGACGGGATATGTACGTGGACCAAGAGCT

GGACATCAACAGACTGTCCGACTACGATGTGGACCATATCGTGCCCCAGTCTTTTCTGAAGG

ACGACTCCATCGACAACAAGGTCCTGACCAGATCCGACAAGAATCGGGGCAAGAGCGACAAC

GTGCCCTCCGAAGAGGTGGTCAAGAAGATGAAGAACTACTGGCGACAGCTGCTGAACGCCAA

GCTGATTACCCAGCGGAAGTTCGACAATCTGACCAAGGCCGAAAGAGGCGGCCTGAGCGAAC

TGGATAAGGCCGGCTTCATCAAGAGACAGCTGGTGGAAACCCGGCAGATCACAAAGCACGTG

GCACAGATTCTGGACTCTCGGATGAACACTAAGTACGACGAGAACGACAAACTGATCCGCGA

AGTGAAAGTCATCACCCTGAAGTCCAAGCTGGTGTCCGATTTCCGGAAGGATTTCCAGTTCT

ACAAAGTGCGCGAGATCAACAACTACCATCACGCCCACGACGCCTACCTGAATGCCGTTGTT

GGAACAGCCCTGATCAAAAAGTACCCTAAGCTGGAAAGCGAGTTCGTGTACGGCGACTACAA

GGTGTACGACGTGCGGAAGATGATCGCCAAGAGCGAGCAAGAGATTGGCAAGGCAACCGCCA

AGTACTTCTTCTACAGCAACATCATGAACTTTTTCAAGACAGAGATCACCCTCGCCAACGGC

GAGATCAGAAAGCGGCCTCTGATCGAGACAAACGGCGAAACCGGCGAGATTGTGTGGGATAA

GGGCAGAGACTTTGCCACAGTGCGGAAAGTGCTGAGCATGCCCCAAGTGAATATCGTGAAGA

AAACCGAGGTGCAGACAGGCGGCTTCAGCAAAGAGTCTATCCTGCCTAAGCGGAACTCCGAC

AAGCTGATCGCCAGAAAGAAGGACTGGGACCCCAAGAAGTACGGCGGCTTCGATTCTCCTAC

CGTGGCCTATAGCGTGCTGGTGGTGGCCAAAGTGGAAAAGGGCAAGTCCAAGAAACTCAAGA

GCGTGAAAGAGCTGCTGGGGATCACCATCATGGAAAGAAGCAGCTTCGAGAAGAATCCGATC

-continued

```
GATTTCCTCGAGGCCAAGGGCTACAAAGAAGTGAAAAAGGACCTGATCATCAAGCTCCCCAA

GTACTCCCTGTTCGAGCTGGAAAACGGCCGGAAGAGAATGCTGGCCTCTGCTGGCGAACTGC

AGAAGGGAAACGAACTGGCCCTGCCTAGCAAATATGTGAACTTCCTGTACCTGGCCAGCCAC

TATGAGAAGCTGAAGGGCAGCCCCGAGGACAATGAGCAAAAGCAGCTGTTTGTGGAACAGCA

CAAGCACTACCTGGACGAGATCATCGAGCAGATCAGCGAGTTTAGCAAGAGAGTGATTCTGG

CCGACGCCAATCTGGACAAAGTGCTGTCCGCCTACAACAAGCACCGGGACAAGCCTATCAGA

GAGCAGGCCGAGAATATCATCCACCTGTTTACCCTGACCAACCTGGGAGCCCCTGCCGCCTT

CAAGTACTTTGACACCACCATCGACCGGAAGCGGTACACCTCCACCAAAGAGGTGCTGGACG

CCACTCTGATCCACCAGTCTATCACCGGCCTGTACGAGACACGGATCGACCTGTCTCAACTC

GGAGGCGACGAAGGCGCCGATAAGAGAACCGCCGATGGCTCTGAGTTCGAGAGCCCCAAGAA

AAAGCGCAAAGTGTGA
```

ABE7.10_Cfa(GEP)-C_Split_T474C:                                                                (SEQ ID NO: 156)

```
ATGGTCAAGATCATCAGCAGAAAGAGCCTGGGCACCCAGAACGTGTACGATATCGGAGTGGG

CGAGCCCCACAACTTTCTGCTCAAGAATGGCCTGGTGGCCAGCAACTGCCCCTGGAACTTCG

AGGAAGTGGTGGACAAGGGCGCCAGCGCTCAGTCCTTCATCGAGCGGATGACCAACTTCGAT

AAGAACCTGCCTAACGAGAAGGTGCTGCCCAAGCACAGCCTGCTGTACGAGTACTTCACCGT

GTACAACGAGCTGACCAAAGTGAAATACGTGACCGAGGGAATGAGAAAGCCCGCCTTTCTGA

GCGGCGAGCAGAAAAAGGCCATCGTGGATCTGCTGTTCAAGACCAACCGGAAAGTGACCGTG

AAGCAGCTGAAAGAGGACTACTTCAAGAAAATCGAGTGCTTCGACAGCGTCGAGATCTCCGG

CGTGGAAGATCGGTTCAATGCCAGCCTGGGCACATACCACGATCTGCTGAAAATTATCAAGG

ACAAGGACTTCCTGGACAACGAAGAGAACGAGGACATCCTTGAGGACATCGTGCTGACACTG

ACCCTGTTTGAGGACGAGAGATGATCGAGGAACGGCTGAAAACATACGCCCACCTGTTCGA

CGACAAAGTGATGAAGCAACTGAAGCGGCGGAGATACACCGGCTGGGGCAGACTGTCTCGGA

AGCTGATCAACGGCATCCGGGATAAGCAGTCCGGCAAGACCATCCTGGACTTTCTGAAGTCC

GACGGCTTCGCCAACAGAAACTTCATGCAGCTGATTCACGACGACAGCCTCACCTTCAAAGA

GGATATCCAGAAAGCCCAGGTGTCCGGCCAGGGCGATTCTCTGCATGAGCACATTGCCAACC

TGGCCGGCTCTCCCGCCATTAAGAAAGGCATCCTGCAGACAGTGAAGGTGGTGGACGAGCTT

GTGAAAGTGATGGGCAGACACAAGCCCGAGAACATCGTGATCGAAATGGCCAGAGAGAACCA

GACCACACAGAAGGGACAGAAGAACAGCCGCGAGAGAATGAAGQGGATCGAAGAGGGCATCA

AAGAGCTGGGCAGCCAGATCCTGAAAGAACACCCCGTGGAAAACACCCAGCTGCAGAACGAG

AAGCTGTACCTGTACTACCTGCAGAATGGACGGGATATGTACGTGGACCAAGAGCTGGACAT

CAACAGACTGTCCGACTACGATGTGGACCATATCGTGCCCCAGTCTTTTCTGAAGGACGACT

CCATCGACAACAAGGTCCTGACCAGATCCGACAAGAATCGGGGCAAGAGCGACAACGTGCCC

TCCGAAGAGGTGGTCAAGAAGATGAAGAACTACTGGCGACAGCTGCTGAACGCCAAGCTGAT

TACCCAGCGGAAGTTCGACAATCTGACCAAGGCCGAAAGAGGCGGCCTGAGCGAACTGGATA

AGGCCGGCTTCATCAAGAGACAGCTGGTGGAAACCCGGCAGATCACAAAGCACGTGGCACAG

ATTCTGGACTCTCGGATGAACACTAAGTACGACGAGAACGACAAACTGATCCGCGAAGTGAA

AGTCATCACCCTGAAGTCCAAGCTGGTGTCCGATTTCCGGAAGGATTTCCAGTTCTACAAAG

TGCGCGAGATCAACAACTACCATCACGCCCACGACGCCTACCTGAATGCCGTTGTTGGAACA

GCCCTGATCAAAAAGTACCCTAAGCTGGAAAGCGAGTTCGTGTACGGCGACTACAAGGTGTA
```

-continued

CGACGTGCGGAAGATGATCGCCAAGAGCGAGCAAGAGATTGGCAAGGCAACCGCCAAGTACT
TCTTCTACAGCAACATCATGAACTTTTTCAAGACAGAGATCACCCTCGCCAACGGCGAGATC
AGAAAGCGGCCTCTGATCGAGACAAACGGCGAAACCGGCGAGATTGTGTGGGATAAGGGCAG
AGACTTTGCCACAGTGCGGAAAGTGCTGAGCATGCCCCAAGTGAATATCGTGAAGAAAACCG
AGGTGCAGACAGGCGGCTTCAGCAAAGAGTCTATCCTGCCTAAGCGGAACTCCGACAAGCTG
ATCGCCAGAAAGAAGGACTGGGACCCCAAGAAGTACGGCGGCTTCGATTCTCCTACCGTGGC
CTATAGCGTGCTGGTGGTGGCCAAAGTGGAAAAGGGCAAGTCCAAGAAACTCAAGAGCGTGA
AAGAGCTGCTGGGGATCACCATCATGGAAAGAAGCAGCTTCGAGAAGAATCCGATCGATTTC
CTCGAGGCCAAGGGCTACAAAGAAGTGAAAAAGGACCTGATCATCAAGCTCCCCAAGTACTC
CCTGTTCGAGCTGGAAAACGGCCGGAAGAGAATGCTGGCCTCTGCTGGCGAACTGCAGAAGG
GAAACGAACTGGCCCTGCCTAGCAAATATGTGAACTTCCTGTACCTGGCCAGCCACTATGAG
AAGCTGAAGGGCAGCCCCGAGGACAATGAGCAAAAGCAGCTGTTTGTGGAACAGCACAAGCA
CTACCTGGACGAGATCATCGAGCAGATCAGCGAGTTTAGCAAGAGAGTGATTCTGGCCGACG
CCAATCTGGACAAAGTGCTGTCCGCCTACAACAAGCACCGGGACAAGCCTATCAGAGAGCAG
GCCGAGAATATCATCCACCTGTTTACCCTGACCAACCTGGGAGCCCCTGCCGCCTTCAAGTA
CTTTGACACCACCATCGACCGGAAGCGGTACACCTCCACCAAAGAGGTGCTGGACGCCACTC
TGATCCACCAGTCTATCACCGGCCTGTACGAGACACGGATCGACCTGTCTCAACTCGGAGGC
GACGAAGGCGCCGATAAGAGAACCGCCGATGGCTCTGAGTTCGAGAGCCCCAAGAAAAAGCG
CAAAGTGTGA

ABE7.10_Cfa(GEP)-C_Split_C574C:
(SEQ ID NO: 157)
ATGGTCAAGATCATCAGCAGAAAGAGCCTGGGCACCCAGAACGTGTACGATATCGGAGTGGG
CGAGCCCCACAACTTTCTGCTCAAGAATGGCCTGGTGGCCAGCAACTGCTTCGACAGCGTCG
AGATCTCCGGCGTGGAAGATCGGTTCAATGCCAGCCTGGGCACATACCACGATCTGCTGAAA
ATTATCAAGGACAAGGACTTCCTGGACAACGAAGAGAACGAGGACATCCTTGAGGACATCGT
GCTGACACTGACCCTGTTTGAGGACAGAGAGATGATCGAGGAACGGCTGAAAACATACGCCC
ACCTGTTCGACGACAAAGTGATGAAGCAACTGAAGCGGCGGAGATACACCGGCTGGGGCAGA
CTGTCTCGGAAGCTGATCAACGGCATCCGGGATAAGCAGTCCGGCAAGACCATCCTGGACTT
TCTGAAGTCCGACGGCTTCGCCAACAGAAACTTCATGCAGCTGATTCACGACGACAGCCTCA
CCTTCAAAGAGGATATCCAGAAAGCCCAGGTGTCCGGCCAGGGCGATTCTCTGCATGAGCAC
ATTGCCAACCTGGCCGGCTCTCCCGCCATTAAGAAAGGCATCCTGCAGACAGTGAAGGTGGT
GGACGAGCTTGTGAAAGTGATGGGCAGACACAAGCCCGAGAACATCGTGATCGAAATGGCCA
GAGAGAACCAGACCACACAGAAGGGACAGAAGAACAGCCGCGAGAGAATGAAGCGGATCGAA
GAGGGCATCAAAGAGCTGGGCAGCCAGATCCTGAAAGAACACCCCGTGGAAAACACCCAGCT
GCAGAACGAGAAGCTGTACCTGTACTACCTGCAGAATGGACGGGATATGTACGTGGACCAAG
AGCTGGACATCAACAGACTGTCCGACTACGATGTGGACCATATCGTGCCCCAGTCTTTTCTG
AAGGACGACTCCATCGACAACAAGGTCCTGACCAGATCCGACAAGAATCGGGGCAAGAGCGA
CAACGTGCCCTCCGAAGAGGTGGTCAAGAAGATGAAGAACTACTGGCGACAGCTGCTGAACG
CCAAGCTGATTACCCAGCGGAAGTTCGACAATCTGACCAAGGCCGAAAGAGGCGGCCTGAGC
GAACTGGATAAGGCCGGCTTCATCAAGAGACAGCTGGTGGAAACCCGGCAGATCACAAAGCA
CGTGGCACAGATTCTGGACTCTCGGATGAACACTAAGTACGACGAGAACGACAAACTGATCC
GCGAAGTGAAAGTCATCACCCTGAAGTCCAAGCTGGTGTCCGATTTCCGGAAGGATTTCCAG -continued TTCTACAAAGTGCGCGAGATCAACAACTACCATCACGCCCACGACGCCTACCTGAATGCCGT
TGTTGGAACAGCCCTGATCAAAAAGTACCCTAAGCTGGAAAGCGAGTTCGTGTACGGCGACT
ACAAGGTGTACGACGTGCGGAAGATGATCGCCAAGAGCGAGCAAGAGATTGGCAAGGCAACC
GCCAAGTACTTCTTCTACAGCAACATCATGAACTTTTTCAAGACAGAGATCACCCTCGCCAA
CGGCGAGATCAGAAAGCGGCCTCTGATCGAGACAAACGGCGAAACCGGCGAGATTGTGTGGG
ATAAGGGCAGAGACTTTGCCACAGTGCGGAAAGTGCTGAGCATGCCCCAAGTGAATATCGTG
AAGAAAACCGAGGTGCAGACAGGCGGCTTCAGCAAAGAGTCTATCCTGCCTAAGCGGAACTC
CGACAAGCTGATCGCCAGAAAGAAGGACTGGGACCCCAAGAAGTACGGCGGCTTCGATTCTC
CTACCGTGGCCTATAGCGTGCTGGTGGTGGCCAAAGTGGAAAAGGGCAAGTCCAAGAAACTC
AAGAGCGTGAAAGAGCTGCTGGGGATCACCATCATGGAAAGAAGCAGCTTCGAGAAGAATCC
GATCGATTTCCTCGAGGCCAAGGGCTACAAAGAAGTGAAAAAGGACCTGATCATCAAGCTCC
CCAAGTACTCCCTGTTCGAGCTGGAAAACGGCCGGAAGAGAATGCTGGCCTCTGCTGGCGAA
CTGCAGAAGGGAAACGAACTGGCCCTGCCTAGCAAATATGTGAACTTCCTGTACCTGGCCAG
CCACTATGAGAAGCTGAAGGGCAGCCCCGAGGACAATGAGCAAAAGCAGCTGTTTGTGGAAC
AGCACAAGCACTACCTGGACGAGATCATCGAGCAGATCAGCGAGTTTAGCAAGAGAGTGATT
CTGGCCGACGCCAATCTGGACAAAGTGCTGTCCGCCTACAACAAGCACCGGGACAAGCCTAT
CAGAGAGCAGGCCGAGAATATCATCCACCTGTTTACCCTGACCAACCTGGGAGCCCCTGCCG
CCTTCAAGTACTTTGACACCACCATCGACCGGAAGCGGTACACCTCCACCAAAGAGGTGCTG
GACGCCACTCTGATCCACCAGTCTATCACCGGCCTGTACGAGACACGGATCGACCTGTCTCA
ACTCGGAGGCGACGAAGGCGCCGATAAGAGAACCGCCGATGGCTCTGAGTTCGAGAGCCCCA
AGAAAAAGCGCAAAGTGTGA ABE7.10_Cfa(GEP)-C_Split_S577C:

(SEQ ID NO: 158)
ATGGTCAAGATCATCAGCAGAAAGAGCCTGGGCACCCAGAACGTGTACGATATCGGAGTGGG
CGAGCCCCACAACTTTCTGCTCAAGAATGGCCTGGTGGCCAGCAACTGCGTCGAGATCTCCG
GCGTGGAAGATCGGTTCAATGCCAGCCTGGGCACATACCACGATCTGCTGAAAATTATCAAG
GACAAGGACTTCCTGGACAACGAAGAGAACGAGGACATCCTTGAGGACATCGTGCTGACACT
GACCCTGTTTGAGGACAGAGAGATGATCGAGGAACGGCTGAAAACATACGCCCACCTGTTCG
ACGACAAAGTGATGAAGCAACTGAAGCGGCGGAGATACACCGGCTGGGGCAGACTGTCTCGG
AAGCTGATCAACGGCATCCGGGATAAGCAGTCCGGCAAGACCATCCTGGACTTTCTGAAGTC
CGACGGCTTCGCCAACAGAAACTTCATGCAGCTGATTCACGACGACAGCCTCACCTTCAAAG
AGGATATCCAGAAAGCCCAGGTGTCCGGCCAGGGCGATTCTCTGCATGAGCACATTGCCAAC
CTGGCCGGCTCTCCCGCCATTAAGAAAGGCATCCTGCAGACAGTGAAGGTGGTGGACGAGCT
TGTGAAAGTGATGGGCAGACACAAGCCCGAGAACATCGTGATCGAAATGGCCAGAGAGAACC
AGACCACACAGAAGGGACAGAAGAACAGCCGCGAGAGAATGAAGCGGATCGAAGAGGGCATC
AAAGAGCTGGGCAGCCAGATCCTGAAAGAACACCCCGTGGAAAACACCCAGCTGCAGAACGA
GAAGCTGTACCTGTACTACCTGCAGAATGGACGGGATATGTACGTGGACCAAGAGCTGGACA
TCAACAGACTGTCCGACTACGATGTGGACCATATCGTGCCCCAGTCTTTTCTGAAGGACGAC
TCCATCGACAACAAGGTCCTGACCAGATCCGACAAGAATCGGGGCAAGAGCGACAACGTGCC
CTCCGAAGAGGTGGTCAAGAAGATGAAGAACTACTGGCGACAGCTGCTGAACGCCAAGCTGA
TTACCCAGCGGAAGTTCGACAATCTGACCAAGGCCGAAAGAGGCGGCCTGAGCGAACTGGAT

-continued

```
AAGGCCGGCTTCATCAAGAGACAGCTGGTGGAAACCCGGCAGATCACAAAGCACGTGGCACA

GATTCTGGACTCTCGGATGAACACTAAGTACGACGAGAACGACAAACTGATCCGCGAAGTGA

AAGTCATCACCCTGAAGTCCAAGCTGGTGTCCGATTTCCGGAAGGATTTCCAGTTCTACAAA

GTGCGCGAGATCAACAACTACCATCACGCCCACGACGCCTACCTGAATGCCGTTGTTGGAAC

AGCCCTGATCAAAAAGTACCCTAAGCTGGAAAGCGAGTTCGTGTACGGCGACTACAAGGTGT

ACGACGTGCGGAAGATGATCGCCAAGAGCGAGCAAGAGATTGGCAAGGCAACCGCCAAGTAC

TTCTTCTACAGCAACATCATGAACTTTTTCAAGACAGAGATCACCCTCGCCAACGGCGAGAT

CAGAAAGCGGCCTCTGATCGAGACAAACGGCGAAACCGGCGAGATTGTGTGGGATAAGGGCA

GAGACTTTGCCACAGTGCGGAAAGTGCTGAGCATGCCCCAAGTGAATATCGTGAAGAAAACC

GAGGTGCAGACAGGCGGCTTCAGCAAAGAGTCTATCCTGCCTAAGCGGAACTCCGACAAGCT

GATCGCCAGAAAGAAGGACTGGGACCCCAAGAAGTACGGCGGCTTCGATTCTCCTACCGTGG

CCTATAGCGTGCTGGTGGTGGCCAAAGTGGAAAAGGGCAAGTCCAAGAAACTCAAGAGCGTG

AAAGAGCTGCTGGGGATCACCATCATGGAAAGAAGCAGCTTCGAGAAGAATCCGATCGATTT

CCTCGAGGCCAAGGGCTACAAAGAAGTGAAAAAGGACCTGATCATCAAGCTCCCCAAGTACT

CCCTGTTCGAGCTGGAAAACGGCCGGAAGAGAATGCTGGCCTCTGCTGGCGAACTGCAGAAG

GGAAACGAACTGGCCCTGCCTAGCAAATATGTGAACTTCCTGTACCTGGCCAGCCACTATGA

GAAGCTGAAGGGCAGCCCCGAGGACAATGAGCAAAAGCAGCTGTTTGTGGAACAGCACAAGC

ACTACCTGGACGAGATCATCGAGCAGATCAGCGAGTTTAGCAAGAGAGTGATTCTGGCCGAC

GCCAATCTGGACAAAGTGCTGTCCGCCTACAACAAGCACCGGGACAAGCCTATCAGAGAGCA

GGCCGAGAATATCATCCACCTGTTTACCCTGACCAACCTGGGAGCCCCTGCCGCCTTCAAGT

ACTTTGACACCACCATCGACCGGAAGCGGTACACCTCCACCAAAGAGGTGCTGGACGCCACT

CTGATCCACCAGTCTATCACCGGCCTGTACGAGACACGGATCGACCTGTCTCAACTCGGAGG

CGACGAAGGCGCCGATAAGAGAACCGCCGATGGCTCTGAGTTCGAGAGCCCCAAGAAAAAGC

GCAAAGTGTGA
```

ABE7.10_Cfa(GEP)-C_Split_A589C:

(SEQ ID NO: 159)

```
ATGGTCAAGATCATCAGCAGAAAGAGCCTGGGCACCCAGAACGTGTACGATATCGGAGTGGG

CGAGCCCCACAACTTTCTGCTCAAGAATGGCCTGGTGGCCAGCAACTGCAGCCTGGGCACAT

ACCACGATCTGCTGAAAATTATCAAGGACAAGGACTTCCTGGACAACGAAGAGAACGAGGAC

ATCCTTGAGGACATCGTGCTGACACTGACCCTGTTTGAGGACAGAGAGATGATCGAGGAACG

GCTGAAAACATACGCCCACCTGTTCGACGACAAAGTGATGAAGCAACTGAAGCGGCGGAGAT

ACACCGGCTGGGGCAGACTGTCTCGGAAGCTGATCAACGGCATCCGGGATAAGCAGTCCGGC

AAGACCATCCTGGACTTTCTGAAGTCCGACGGCTTCGCCAACAGAAACTTCATGCAGCTGAT

TCACGACGACAGCCTCACCTTCAAAGAGGATATCCAGAAAGCCCAGGTGTCCGGCCAGGGCG

ATTCTCTGCATGAGCACATTGCCAACCTGGCCGGCTCTCCCGCCATTAAGAAAGGCATCCTG

CAGACAGTGAAGGTGGTGGACGAGCTTGTGAAAGTGATGGGCAGACACAAGCCCGAGAACAT

CGTGATCGAAATGGCCAGAGAGAACCAGACCACACAGAAGGGACAGAAGAACAGCCGCGAGA

GAATGAAGCGGATCGAAGAGGGCATCAAAGAGCTGGGCAGCCAGATCCTGAAAGAACACCCC

GTGGAAAACACCCAGCTGCAGAACGAGAAGCTGTACCTGTACTACCTGCAGAATGGACGGGA

TATGTACGTGGACCAAGAGCTGGACATCAACAGACTGTCCGACTACGATGTGGACCATATCG

TGCCCCAGTCTTTTCTGAAGGACGACTCCATCGACAACAAGGTCCTGACCAGATCCGACAAG

AATCGGGGCAAGAGCGACAACGTGCCCTCCGAAGAGGTGGTCAAGAAGATGAAGAACTACTG
```

-continued

```
GCGACAGCTGCTGAACGCCAAGCTGATTACCCAGCGGAAGTTCGACAATCTGACCAAGGCCG
AAAGAGGCGGCCTGAGCGAACTGGATAAGGCCGGCTTCATCAAGAGACAGCTGGTGGAAACC
CGGCAGATCACAAAGCACGTGGCACAGATTCTGGACTCTCGGATGAACACTAAGTACGACGA
GAACGACAAACTGATCCGCGAAGTGAAAGTCATCACCCTGAAGTCCAAGCTGGTGTCCGATT
TCCGGAAGGATTTCCAGTTCTACAAAGTGCGCGAGATCAACAACTACCATCACGCCCACGAC
GCCTACCTGAATGCCGTTGTTGGAACAGCCCTGATCAAAAAGTACCCTAAGCTGGAAAGCGA
GTTCGTGTACGGCGACTACAAGGTGTACGACGTGCGGAAGATGATCGCCAAGAGCGAGCAAG
AGATTGGCAAGGCAACCGCCAAGTACTTCTTCTACAGCAACATCATGAACTTTTTCAAGACA
GAGATCACCCTCGCCAACGGCGAGATCAGAAAGCGGCCTCTGATCGAGACAAACGGCGAAAC
CGGCGAGATTGTGTGGGATAAGGGCAGAGACTTTGCCACAGTGCGGAAAGTGCTGAGCATGC
CCCAAGTGAATATCGTGAAGAAAACCGAGGTGCAGACAGGCGGCTTCAGCAAAGAGTCTATC
CTGCCTAAGCGGAACTCCGACAAGCTGATCGCCAGAAAGAAGGACTGGGACCCCAAGAAGTA
CGGCGGCTTCGATTCTCCTACCGTGGCCTATAGCGTGCTGGTGGTGGCCAAAGTGGAAAAGG
GCAAGTCCAAGAAACTCAAGAGCGTGAAAGAGCTGCTGGGGATCACCATCATGGAAAGAAGC
AGCTTCGAGAAGAATCCGATCGATTTCCTCGAGGCCAAGGGCTACAAAGAAGTGAAAAAGGA
CCTGATCATCAAGCTCCCCAAGTACTCCCTGTTCGAGCTGGAAAACGGCCGGAAGAGAATGC
TGGCCTCTGCTGGCGAACTGCAGAAGGGAAACGAACTGGCCCTGCCTAGCAAATATGTGAAC
TTCCTGTACCTGGCCAGCCACTATGAGAAGCTGAAGGGCAGCCCCGAGGACAATGAGCAAAA
GCAGCTGTTTGTGGAACAGCACAAGCACTACCTGGACGAGATCATCGAGCAGATCAGCGAGT
TTAGCAAGAGAGTGATTCTGGCCGACGCCAATCTGGACAAAGTGCTGTCCGCCTACAACAAG
CACCGGGACAAGCCTATCAGAGAGCAGGCCGAGAATATCATCCACCTGTTTACCCTGACCAA
CCTGGGAGCCCCTGCCGCCTTCAAGTACTTTGACACCACCATCGACCGGAAGCGGTACACCT
CCACCAAAGAGGTGCTGGACGCCACTCTGATCCACCAGTCTATCACCGGCCTGTACGAGACA
CGGATCGACCTGTCTCAACTCGGAGGCGACGAAGGCGCCGATAAGAGAACCGCCGATGGCTC
TGAGTTCGAGAGCCCCAAGAAAAAGCGCAAAGTGTGA
```

ABE7.10_Cfa(GEP)-C_Split_S590C:

(SEQ ID NO: 160)
```
ATGGTCAAGATCATCAGCAGAAAGAGCCTGGGCACCCAGAACGTGTACGATATCGGAGTGGG
CGAGCCCCACAACTTTCTGCTCAAGAATGGCCTGGTGGCCAGCAACTGCCTGGGCACATACC
ACGATCTGCTGAAAATTATCAAGGACAAGGACTTCCTGGACAACGAAGAGAACGAGGACATC
CTTGAGGACATCGTGCTGACACTGACCCTGTTTGAGGACAGAGAGATGATCGAGGAACGGCT
GAAAACATACGCCCACCTGTTCGACGACAAAGTGATGAAGCAACTGAAGCGGCGGAGATACA
CCGGCTGGGGCAGACTGTCTCGGAAGCTGATCAACGGCATCCGGGATAAGCAGTCCGGCAAG
ACCATCCTGGACTTTCTGAAGTCCGACGGCTTCGCCAACAGAAACTTCATGCAGCTGATTCA
CGACGACAGCCTCACCTTCAAAGAGGATATCCAGAAAGCCCAGGTGTCCGGCCAGGGCGATT
CTCTGCATGAGCACATTGCCAACCTGGCCGGCTCTCCCGCCATTAAGAAAGGCATCCTGCAG
ACAGTGAAGGTGGTGGACGAGCTTGTGAAAGTGATGGGCAGACACAAGCCCGAGAACATCGT
GATCGAAATGGCCAGAGAGAACCAGACCACACAGAAGGGACAGAAGAACAGCCGCGAGAGAA
TGAAGCGGATCGAAGAGGGCATCAAAGAGCTGGGCAGCCAGATCCTGAAAGAACACCCCGTG
GAAAACACCCAGCTGCAGAACGAGAAGCTGTACCTGTACTACCTGCAGAATGGACGGGATAT
GTACGTGGACCAAGAGCTGGACATCAACAGACTGTCCGACTACGATGTGGACCATATCGTGC
```

-continued

```
CCCAGTCTTTTCTGAAGGACGACTCCATCGACAACAAGGTCCTGACCAGATCCGACAAGAAT

CGGGGCAAGAGCGACAACGTGCCCTCCGAAGAGGTGGTCAAGAAGATGAAGAACTACTGGCG

ACAGCTGCTGAACGCCAAGCTGATTACCCAGCGGAAGTTCGACAATCTGACCAAGGCCGAAA

GAGGCGGCCTGAGCGAACTGGATAAGGCCGGCTTCATCAAGAGACAGCTGGTGGAAACCCGG

CAGATCACAAAGCACGTGGCACAGATTCTGGACTCTCGGATGAACACTAAGTACGACGAGAA

CGACAAACTGATCCGCGAAGTGAAAGTCATCACCCTGAAGTCCAAGCTGGTGTCCGATTTCC

GGAAGGATTTCCAGTTCTACAAAGTGCGCGAGATCAACAACTACCATCACGCCCACGACGCC

TACCTGAATGCCGTTGTTGGAACAGCCCTGATCAAAAAGTACCCTAAGCTGGAAAGCGAGTT

CGTGTACGGCGACTACAAGGTGTACGACGTGCGGAAGATGATCGCCAAGAGCGAGCAAGAGA

TTGGCAAGGCAACCGCCAAGTACTTCTTCTACAGCAACATCATGAACTTTTTCAAGACAGAG

ATCACCCTCGCCAACGGCGAGATCAGAAAGCGGCCTCTGATCGAGACAAACGGCGAAACCGG

CGAGATTGTGTGGGATAAGGGCAGAGACTTTGCCACAGTGCGGAAAGTGCTGAGCATGCCCC

AAGTGAATATCGTGAAGAAAACCGAGGTGCAGACAGGCGGCTTCAGCAAAGAGTCTATCCTG

CCTAAGCGGAACTCCGACAAGCTGATCGCCAGAAAGAAGGACTGGGACCCCAAGAAGTACGG

CGGCTTCGATTCTCCTACCGTGGCCTATAGCGTGCTGGTGGTGGCCAAAGTGGAAAAGGGCA

AGTCCAAGAAACTCAAGAGCGTGAAAGAGCTGCTGGGGATCACCATCATGGAAAGAAGCAGC

TTCGAGAAGAATCCGATCGATTTCCTCGAGGCCAAGGGCTACAAAGAAGTGAAAAAGGACCT

GATCATCAAGCTCCCCAAGTACTCCCTGTTCGAGCTGGAAAACGGCCGGAAGAGAATGCTGG

CCTCTGCTGGCGAACTGCAGAAGGGAAACGAACTGGCCCTGCCTAGCAAATATGTGAACTTC

CTGTACCTGGCCAGCCACTATGAGAAGCTGAAGGGCAGCCCCGAGGACAATGAGCAAAAGCA

GCTGTTTGTGGAACAGCACAAGCACTACCTGGACGAGATCATCGAGCAGATCAGCGAGTTTA

GCAAGAGAGTGATTCTGGCCGACGCCAATCTGGACAAAGTGCTGTCCGCCTACAACAAGCAC

CGGGACAAGCCTATCAGAGAGCAGGCCGAGAATATCATCCACCTGTTTACCCTGACCAACCT

GGGAGCCCCTGCCGCCTTCAAGTACTTTGACACCACCATCGACCGGAAGCGGTACACCTCCA

CCAAAGAGGTGCTGGACGCCACTCTGATCCACCAGTCTATCACCGGCCTGTACGAGACACGG

ATCGACCTGTCTCAACTCGGAGGCGACGAAGGCGCCGATAAGAGAACCGCCGATGGCTCTGA

GTTCGAGAGCCCCAAGAAAAAGCGCAAAGTGTGA
```

Intact ABE7.10:
(SEQ ID NO: 161)
```
MSEVEFSHEYWMRHALTLAKRAWDEREVPVGAVLVHNNRVIGEGWNRPIGRHDPTAHAEIMA

LRQGGLVMQNYRLIDATLYVTLEPCVMCAGAMIHSRIGRVVEGARDAKTGAAGSLMDVLHHP

GMNHRVEITEGILADECAALLSDFFRMRRQEIKAQKKAQSSTDSGGSSGGSSGSETPGTSES

ATPESSGGSSGGSSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIGRVVFGVRNAKTG

AAGSLMDVLHYPGMNHRVEITEGILADECAALLCYFFRMPRQVENAQKKAQSSTDSGGSSGG

SSGSETPGTSESATPESSGGSSGGSDKKYSIGLAIGTNSVGWAVITDEYKVPSKKFKVLGNT

DRHSIKKNLIGALLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKADLRLIYLALAHMI

KFRGHFLIEGDLNPDNSDVDKLFIQLVQTYNQLFEENPINASGVDAKAILSARLSKSRRLEN

LIAQLPGEKKNGLFGNLIALSLGLTPNFKSNFDLAEDAKLQLSKDTYDDDLDNLLAQIGDQY

ADLFLAAKNLSDAILLSDILRVNTEITKAPLSASMIKRYDEHHQDLTLLKALVRQQLPEKYK

EIFFDQSKNGYAGYIDGGASQEEFYKFIKPILEKMDGTEELLVKLNREDLLRKQRTEDNGSI
```

-continued

PHQIHLGELHAILRRQEDFYPFLKDNREKIEKILTFRIPYYVGPLARGNSRFAWMTRKSEET

ITPWNFEEVVDKGASAQSFIERMTNFDKNLPNEKVLPKHSLLYEYFTVYNELTKVKYVTEGM

RKPAFLSGEQKKAIVDLLEKTNRKVTVKQLKEDYFKKIECFDSVEISGVEDRENASLGTYHD

LLKIIKDKDFLDNEENEDILEDIVLTLTLFEDREMIEERLKTYAHLEDDKVMKQLKRRRYTG

WGRLSRKLINGIRDKQSGKTILDFLKSDGFANRNFMQLIHDDSLTFKEDIQKAQVSGQGDSL

HEHIANLAGSPAIKKGILQTVKVVDELVKVMGRHKPENIVIEMARENQTTQKGQKNSRERMK

RIEEGIKELGSQILKEHPVENTQLQNEKLYLYYLQNGRDMYVDQELDINRLSDYDVDHIVPQ

SFLKDDSIDNKVLTRSDKNRGKSDNVPSEEVVKKMKNYWRQLLNAKLITQRKFDNLTKAERG

GLSELDKAGFIKRQLVETRQITKHVAQILDSRMNTKYDENDKLIREVKVITLKSKLVSDERK

DFQFYKVREINNYHHAHDAYLNAVVGTALIKKYPKLESEFVYGDYKVYDVRKMIAKSEQEIG

KATAKYFFYSNIMNFFKTEITLANGEIRKRPLIETNGETGEIVWDKGRDFATVRKVLSMPQV

NIVKKTEVQTGGESKESILPKRNSDKLIARKKDWDPKKYGGFDSPTVAYSVLVVAKVEKGKS

KKLKSVKELLGITIMERSSFEKNPIDFLEAKGYKEVKKDLIIKLPKYSLFELENGRKRMLAS

AGELQKGNELALPSKYVNFLYLASHYEKLKGSPEDNEQKQLFVEQHKHYLDEIIEQISEFSK

RVILADANLDKVLSAYNKHRDKPIREQAENIIHLFTLTNLGAPAAFKYEDTTIDRKRYTSTK

EVLDATLIHQSITGLYETRIDLSQLGGDEGADKRTADGSEFESPKKKRKV

ABE7.10_Cfa-N_Split_S303C:
(SEQ ID NO: 162)
MSEVEFSHEYWMRHALTLAKRAWDEREVPVGAVLVHNNRVIGEGWNRPIGRHDPTAHAEIMA

LRQGGLVMQNYRLIDATLYVTLEPCVMCAGAMIHSRIGRVVFGARDAKTGAAGSLMDVLHHP

GMNHRVEITEGILADECAALLSDFFRMRRQEIKAQKKAQSSTDSGGSSGGSSGSETPGTSES

ATPESSGGSSGGSSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIGRVVFGVRNAKTG

AAGSLMDVLHYPGMNHRVEITEGILADECAALLCYFFRMPRQVENAQKKAQSSTDSGGSSGG

SSGSETPGTSESATPESSGGSSGGSDKKYSIGLAIGTNSVGWAVITDEYKVPSKKFKVLGNT

DRHSIKKNLIGALLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKADLRLIYLALAHMI

KFRGHFLIEGDLNPDNSDVDKLFIQLVQTYNQLFEENPINASGVDAKAILSARLSKSRRLEN

LIAQLPGEKKNGLFGNLIALSLGLTPNEKSNEDLAEDAKLQLSKDTYDDDLDNLLAQIGDQY

ADLFLAAKNLSDAILLCLSYDTEILTVEYGFLPIGKIVEERIECTVYTVDKNGFVYTQPIAQ

WHNRGEQEVFEYCLEDGSIIRATKDHKFMTTDGQMLPIDEIFERGLDLKQVDGLP

ABE7.10_Cfa-N_Split_T310C:
(SEQ ID NO: 163)
MSEVEFSHEYWMRHALTLAKRAWDEREVPVGAVLVHNNRVIGEGWNRPIGRHDPTAHAEIMA

LRQGGLVMQNYRLIDATLYVTLEPCVMCAGAMIHSRIGRVVFGARDAKTGAAGSLMDVLHHP

GMNHRVEITEGILADECAALLSDFFRMRRQEIKAQKKAQSSTDSGGSSGGSSGSETPGTSES

ATPESSGGSSGGSSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIGRVVFGVRNAKTG

AAGSLMDVLHYPGMNHRVEITEGILADECAALLCYFFRMPRQVENAQKKAQSSTDSGGSSGG

SSGSETPGTSESATPESSGGSSGGSDKKYSIGLAIGTNSVGWAVITDEYKVPSKKFKVLGNT

DRHSIKKNLIGALLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKADLRLIYLALAHMI

-continued

KFRGHFLIEGDLNPDNSDVDKLFIQLVQTYNQLFEENPINASGVDAKAILSARLSKSRRLEN

LIAQLPGEKKNGLFGNLIALSLGLTPNFKSNFDLAEDAKLQLSKDTYDDDLDNLLAQIGDQY

ADLFLAAKNLSDAILLSDILRVNCLSYDTEILTVEYGFLPIGKIVEERIECTVYTVDKNGFV

YTQPIAQWHNRGEQEVFEYCLEDGSIIRATKDHKEMTTDGQMLPIDEIFERGLDLKQVDGLP

ABE7.10_Cfa-N_Split_T313C:
(SEQ ID NO: 164)
MSEVEFSHEYWMRHALTLAKRAWDEREVPVGAVLVHNNRVIGEGWNRPIGRHDPTAHAEIMA

LRQGGLVMQNYRLIDATLYVTLEPCVMCAGAMIHSRIGRVVFGARDAKTGAAGSLMDVLHHP

GMNHRVEITEGILADECAALLSDEFRMRRQEIKAQKKAQSSTDSGGSSGGSSGSETPGTSES

ATPESSGGSSGGSSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIGRVVFGVRNAKTG

AAGSLMDVLHYPGMNHRVEITEGILADECAALLCYFFRMPRQVFNAQKKAQSSTDSGGSSGG

SSGSETPGTSESATPESSGGSSGGSDKKYSIGLAIGTNSVGWAVITDEYKVPSKKFKVLGNT

DRHSIKKNLIGALLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKADLRLIYLALAHMI

KFRGHFLIEGDLNPDNSDVDKLFIQLVQTYNQLFEENPINASGVDAKAILSARLSKSRRLEN

LIAQLPGEKKNGLFGNLIALSLGLTPNFKSNFDLAEDAKLQLSKDTYDDDLDNLLAQIGDQY

ADLFLAAKNLSDAILLSDILRVNTEICLSYDTEILTVEYGFLPIGKIVEERIECTVYTVDKN

GFVYTQPIAQWHNRGEQEVFEYCLEDGSIIRATKDHKFMTTDGQMLPIDEIFERGLDLKQVD

GLP

ABE7.10_Cfa-N_Split_S355C:
(SEQ ID NO: 165)
MSEVEFSHEYWMRHALTLAKRAWDEREVPVGAVLVHNNRVIGEGWNRPIGRHDPTAHAEIMA

LRQGGLVMQNYRLIDATLYVTLEPCVMCAGAMIHSRIGRVVFGARDAKTGAAGSLMDVLHHP

GMNHRVEITEGILADECAALLSDFFRMRRQEIKAQKKAQSSTDSGGSSGGSSGSETPGTSES

ATPESSGGSSGGSSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIGRVVFGVRNAKTG

AAGSLMDVLHYPGMNHRVEITEGILADECAALLCYFFRMPRQVENAQKKAQSSTDSGGSSGG

SSGSETPGTSESATPESSGGSSGGSDKKYSIGLAIGTNSVGWAVITDEYKVPSKKFKVLGNT

DRHSIKKNLIGALLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKADLRLIYLALAHMI

KFRGHFLIEGDLNPDNSDVDKLFIQLVQTYNQLFEENPINASGVDAKAILSARLSKSRRLEN

LIAQLPGEKKNGLFGNLIALSLGLTPNFKSNFDLAEDAKLQLSKDTYDDDLDNLLAQIGDQY

ADLFLAAKNLSDAILLSDILRVNTEITKAPLSASMIKRYDEHHQDLTLLKALVRQQLPEKYK

EIFFDQCLSYDTEILTVEYGELPIGKIVEERIECTVYTVDKNGFVYTQPIAQWHNRGEQEVE

EYCLEDGSIIRATKDHKEMTTDGQMLPIDEIFERGLDLKQVDGLP

ABE7.10_Cfa-N_Split_A456C:
(SEQ ID NO: 166)
MSEVEFSHEYWMRHALTLAKRAWDEREVPVGAVLVHNNRVIGEGWNRPIGRHDPTAHAEIMA

LRQGGLVMQNYRLIDATLYVTLEPCVMCAGAMIHSRIGRVVFGARDAKTGAAGSLMDVLHHP

GMNHRVEITEGILADECAALLSDFFRMRRQEIKAQKKAQSSTDSGGSSGGSSGSETPGTSES

ATPESSGGSSGGSSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIGRVVFGVRNAKTG

AAGSLMDVLHYPGMNHRVEITEGILADECAALLCYFFRMPRQVENAQKKAQSSTDSGGSSGG

-continued

SSGSETPGTSESATPESSGGSSGGSDKKYSIGLAIGTNSVGWAVITDEYKVPSKKFKVLGNT

DRHSIKKNLIGALLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKADLRLIYLALAHMI

KFRGHFLIEGDLNPDNSDVDKLFIQLVQTYNQLFEENPINASGVDAKAILSARLSKSRRLEN

LIAQLPGEKKNGLFGNLIALSLGLTPNFKSNEDLAEDAKLQLSKDTYDDDLDNLLAQIGDQY

ADLFLAAKNLSDAILLSDILRVNTEITKAPLSASMIKRYDEHHQDLTLLKALVRQQLPEKYK

EIFFDQSKNGYAGYIDGGASQEEFYKFIKPILEKMDGTEELLVKLNREDLLRKQRTEDNGSI

PHQIHLGELHAILRRQEDFYPFLKDNREKIEKILTFRIPYYVGPLCLSYDTEILTVEYGFLP

IGKIVEERIECTVYTVDKNGFVYTQPIAQWHNRGEQEVFEYCLEDGSIIRATKDHKFMTTDG

QMLPIDEIFERGLDLKQVDGLP

ABE7.10_Cfa-N_Split_S460C:
(SEQ ID NO: 167)
MSEVEFSHEYWMRHALTLAKRAWDEREVPVGAVLVHNNRVIGEGWNRPIGRHDPTAHAEIMA

LRQGGLVMQNYRLIDATLYVTLEPCVMCAGAMIHSRIGRVVFGARDAKTGAAGSLMDVLHHP

GMNHRVEITEGILADECAALLSDFFRMRRQEIKAQKKAQSSTDSGGSSGGSSGSETPGTSES

ATPESSGGSSGGSSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIGRVVFGVRNAKTG

AAGSLMDVLHYPGMNHRVEITEGILADECAALLCYFFRMPRQVENAQKKAQSSTDSGGSSGG

SSGSETPGTSESATPESSGGSSGGSDKKYSIGLAIGTNSVGWAVITDEYKVPSKKFKVLGNT

DRHSIKKNLIGALLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKADLRLIYLALAHMI

KFRGHFLIEGDLNPDNSDVDKLFIQLVQTYNQLFEENPINASGVDAKAILSARLSKSRRLEN

LIAQLPGEKKNGLFGNLIALSLGLTPNFKSNEDLAEDAKLQLSKDTYDDDLDNLLAQIGDQY

ADLFLAAKNLSDAILLSDILRVNTEITKAPLSASMIKRYDEHHQDLTLLKALVRQQLPEKYK

EIFFDQSKNGYAGYIDGGASQEEFYKFIKPILEKMDGTEELLVKLNREDLLRKQRTEDNGSI

PHQIHLGELHAILRRQEDFYPELKDNREKIEKILTFRIPYYVGPLARGNCLSYDTEILTVEY

GFLPIGKIVEERIECTVYTVDKNGFVYTQPIAQWHNRGEQEVFEYCLEDGSIIRATKDHKFM

TTDGQMLPIDEIFERGLDLKQVDGLP

ABE7.10_Cfa-N_Split_A463C:
(SEQ ID NO: 168)
MSEVEFSHEYWMRHALTLAKRAWDEREVPVGAVLVHNNRVIGEGWNRPIGRHDPTAHAEIMA

LRQGGLVMQNYRLIDATLYVTLEPCVMCAGAMIHSRIGRVVFGARDAKTGAAGSLMDVLHHP

GMNHRVEITEGILADECAALLSDFFRMRRQEIKAQKKAQSSTDSGGSSGGSSGSETPGTSES

ATPESSGGSSGGSSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIGRVVFGVRNAKTG

AAGSLMDVLHYPGMNHRVEITEGILADECAALLCYFFRMPRQVENAQKKAQSSTDSGGSSGG

SSGSETPGTSESATPESSGGSSGGSDKKYSIGLAIGTNSVGWAVITDEYKVPSKKFKVLGNT

DRHSIKKNLIGALLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKADLRLIYLALAHMI

KFRGHFLIEGDLNPDNSDVDKLFIQLVQTYNQLFEENPINASGVDAKAILSARLSKSRRLEN

LIAQLPGEKKNGLFGNLIALSLGLTPNFKSNFDLAEDAKLQLSKDTYDDDLDNLLAQIGDQY

ADLFLAAKNLSDAILLSDILRVNTEITKAPLSASMIKRYDEHHQDLTLLKALVRQQLPEKYK

-continued

EIFFDQSKNGYAGYIDGGASQEEFYKFIKPILEKMDGTEELLVKLNREDLLRKQRTEDNGSI

PHQIHLGELHAILRRQEDFYPFLKDNREKIEKILTFRIPYYVGPLARGNSRFCLSYDTEILT

VEYGFLPIGKIVEERIECTVYTVDKNGFVYTQPIAQWHNRGEQEVFEYCLEDGSIIRATKDH

KFMTTDGQMLPIDEIFERGLDLKQVDGLP

ABE7.10_Cfa-N_Split_T466C:

(SEQ ID NO: 169)

MSEVEFSHEYWMRHALTLAKRAWDEREVPVGAVLVHNNRVIGEGWNRPIGRHDPTAHAEIMA

LRQGGLVMQNYRLIDATLYVTLEPCVMCAGAMIHSRIGRVVFGARDAKTGAAGSLMDVLHHP

GMNHRVEITEGILADECAALLSDFFRMRRQEIKAQKKAQSSTDSGGSSGGSSGSETPGTSES

ATPESSGGSSGGSSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIGRVVFGVRNAKTG

AAGSLMDVLHYPGMNHRVEITEGILADECAALLCYFFRMPRQVENAQKKAQSSTDSGGSSGG

SSGSETPGTSESATPESSGGSSGGSDKKYSIGLAIGTNSVGWAVITDEYKVPSKKFKVLGNT

DRHSIKKNLIGALLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKADLRLIYLALAHMI

KFRGHFLIEGDLNPDNSDVDKLFIQLVQTYNQLFEENPINASGVDAKAILSARLSKSRRLEN

LIAQLPGEKKNGLFGNLIALSLGLTPNFKSNFDLAEDAKLQLSKDTYDDDLDNLLAQIGDQY

ADLFLAAKNLSDAILLSDILRVNTEITKAPLSASMIKRYDEHHQDLTLLKALVRQQLPEKYK

EIFFDQSKNGYAGYIDGGASQEEFYKFIKPILEKMDGTEELLVKLNREDLLRKQRTEDNGSI

PHQIHLGELHAILRRQEDFYPFLKDNREKIEKILTFRIPYYVGPLARGNSRFAWMCLSYDTE

ILTVEYGFLPIGKIVEERIECTVYTVDKNGFVYTQPIAQWHNRGEQEVFEYCLEDGSIIRAT

KDHKFMTTDGQMLPIDEIFERGLDLKQVDGLP

ABE7.10_Cfa-N_Split_S469C:

(SEQ ID NO: 170)

MSEVEFSHEYWMRHALTLAKRAWDEREVPVGAVLVHNNRVIGEGWNRPIGRHDPTAHAEIMA

LRQGGLVMQNYRLIDATLYVTLEPCVMCAGAMIHSRIGRVVFGARDAKTGAAGSLMDVLHHP

GMNHRVEITEGILADECAALLSDFERMRRQEIKAQKKAQSSTDSGGSSGGSSGSETPGTSES

ATPESSGGSSGGSSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIGRVVFGVRNAKTG

AAGSLMDVLHYPGMNHRVEITEGILADECAALLCYFFRMPRQVENAQKKAQSSTDSGGSSGG

SSGSETPGTSESATPESSGGSSGGSDKKYSIGLAIGTNSVGWAVITDEYKVPSKKFKVLGNT

DRHSIKKNLIGALLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKADLRLIYLALAHMI

KFRGHFLIEGDLNPDNSDVDKLFIQLVQTYNQLFEENPINASGVDAKAILSARLSKSRRLEN

LIAQLPGEKKNGLFGNLIALSLGLTPNFKSNFDLAEDAKLQLSKDTYDDDLDNLLAQIGDQY

ADLFLAAKNLSDAILLSDILRVNTEITKAPLSASMIKRYDEHHQDLTLLKALVRQQLPEKYK

EIFFDQSKNGYAGYIDGGASQEEFYKFIKPILEKMDGTEELLVKLNREDLLRKQRTEDNGSI

PHQIHLGELHAILRRQEDFYPFLKDNREKIEKILTFRIPYYVGPLARGNSRFAWMTRKCLSY

DTEILTVEYGFLPIGKIVEERIECTVYTVDKNGFVYTQPIAQWHNRGEQEVFEYCLEDGSII

RATKDHKFMTTDGQMLPIDEIFERGLDLKQVDGLP

ABE7.10_Cfa-N_Split_T472C:

(SEQ ID NO: 171)

MSEVEFSHEYWMRHALTLAKRAWDEREVPVGAVLVHNNRVIGEGWNRPIGRHDPTAHAEIMA

LRQGGLVMQNYRLIDATLYVTLEPCVMCAGAMIHSRIGRVVFGARDAKTGAAGSLMDVLHHP

```
GMNHRVEITEGILADECAALLSDFFRMRRQEIKAQKKAQSSTDSGGSSGGSSGSETPGTSES

ATPESSGGSSGGSSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIGRVVFGVRNAKTG

AAGSLMDVLHYPGMNHRVEITEGILADECAALLCYFFRMPRQVENAQKKAQSSTDSGGSSGG

SSGSETPGTSESATPESSGGSSGGSDKKYSIGLAIGTNSVGWAVITDEYKVPSKKFKVLGNT

DRHSIKKNLIGALLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKADLRLIYLALAHMI

KFRGHFLIEGDLNPDNSDVDKLFIQLVQTYNQLFEENPINASGVDAKAILSARLSKSRRLEN

LIAQLPGEKKNGLFGNLIALSLGLTPNEKSNEDLAEDAKLQLSKDTYDDDLDNLLAQIGDQY

ADLFLAAKNLSDAILLSDILRVNTEITKAPLSASMIKRYDEHHQDLTLLKALVRQQLPEKYK

EIFFDQSKNGYAGYIDGGASQEEFYKFIKPILEKMDGTEELLVKLNREDLLRKQRTEDNGSI

PHQIHLGELHAILRRQEDFYPFLKDNREKIEKILTFRIPYYVGPLARGNSRFAWMTRKSEEC

LSYDTEILTVEYGFLPIGKIVEERIECTVYTVDKNGFVYTQPIAQWHNRGEQEVFEYCLEDG

SIIRATKDHKFMTTDGQMLPIDEIFERGLDLKQVDGLP

ABE7.10_Cfa-N_Split_T474C:
                                                        (SEQ ID NO: 172)
MSEVEFSHEYWMRHALTLAKRAWDEREVPVGAVLVHNNRVIGEGWNRPIGRHDPTAHAEIMA

LRQGGLVMQNYRLIDATLYVTLEPCVMCAGAMIHSRIGRVVFGARDAKTGAAGSLMDVLHHP

GMNHRVEITEGILADECAALLSDFFRMRRQEIKAQKKAQSSTDSGGSSGGSSGSETPGTSES

ATPESSGGSSGGSSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIGRVVFGVRNAKTG

AAGSLMDVLHYPGMNHRVEITEGILADECAALLCYFFRMPRQVENAQKKAQSSTDSGGSSGG

SSGSETPGTSESATPESSGGSSGGSDKKYSIGLAIGTNSVGWAVITDEYKVPSKKFKVLGNT

DRHSIKKNLIGALLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKADLRLIYLALAHMI

KFRGHFLIEGDLNPDNSDVDKLFIQLVQTYNQLFEENPINASGVDAKAILSARLSKSRRLEN

LIAQLPGEKKNGLFGNLIALSLGLTPNFKSNEDLAEDAKLQLSKDTYDDDLDNLLAQIGDQY

ADLFLAAKNLSDAILLSDILRVNTEITKAPLSASMIKRYDEHHQDLTLLKALVRQQLPEKYK

EIFFDQSKNGYAGYIDGGASQEEFYKFIKPILEKMDGTEELLVKLNREDLLRKQRTEDNGSI

PHQIHLGELHAILRRQEDFYPFLKDNREKIEKILTFRIPYYVGPLARGNSRFAWMTRKSEET

ICLSYDTEILTVEYGFLPIGKIVEERIECTVYTVDKNGFVYTQPIAQWHNRGEQEVFEYCLE

DGSIIRATKDHKFMTTDGQMLPIDEIFERGLDLKQVDGLP

ABE7.10_Cfa-N_Split_C574C:
                                                        (SEQ ID NO: 173)
MSEVEFSHEYWMRHALTLAKRAWDEREVPVGAVLVHNNRVIGEGWNRPIGRHDPTAHAEIMA

LRQGGLVMQNYRLIDATLYVTLEPCVMCAGAMIHSRIGRVVEGARDAKTGAAGSLMDVLHHP

GMNHRVEITEGILADECAALLSDFFRMRRQEIKAQKKAQSSTDSGGSSGGSSGSETPGTSES

ATPESSGGSSGGSSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIGRVVFGVRNAKTG

AAGSLMDVLHYPGMNHRVEITEGILADECAALLCYFFRMPRQVENAQKKAQSSTDSGGSSGG

SSGSETPGTSESATPESSGGSSGGSDKKYSIGLAIGTNSVGWAVITDEYKVPSKKFKVLGNT

DRHSIKKNLIGALLFDSGETAEATRLKRTARRRYTRRKNRICYLQEIFSNEMAKVDDSFFHR
```

-continued

LEESFLVEEDKKHERHPIFGNIVDEVAYHEKYPTIYHLRKKLVDSTDKADLRLIYLALAHMI

KFRGHFLIEGDLNPDNSDVDKLFIQLVQTYNQLFEENPINASGVDAKAILSARLSKSRRLEN

LIAQLPGEKKNGLFGNLIALSLGLTPNFKSNFDLAEDAKLQLSKDTYDDDLDNLLAQIGDQY

ADLFLAAKNLSDAILLSDILRVNTEITKAPLSASMIKRYDEHHQDLTLLKALVRQQLPEKYK

EIFFDQSKNGYAGYIDGGASQEEFYKFIKPILEKMDGTEELLVKLNREDLLRKQRTEDNGSI

PHQIHLGELHAILRRQEDFYPFLKDNREKIEKILTFRIPYYVGPLARGNSRFAWMTRKSEET

ITPWNFEEVVDKGASAQSFIERMTNFDKNLPNEKVLPKHSLLYEYFTVYNELTKVKYVTEGM

RKPAFLSGEQKKAIVDLLFKTNRKVTVKQLKEDYFKKIECLSYDTEILTVEYGELPIGKIVE

ERIECTVYTVDKNGFVYTQPIAQWHNRGEQEVFEYCLEDGSIIRATKDHKFMTTDGQMLPID

EIFERGLDLKQVDGLP

ABE7.10_Cfa-N_Split_S577C:
(SEQ ID NO: 174)
MSEVEFSHEYWMRHALTLAKRAWDEREVPVGAVLVHNNRVIGEGWNRPIGRHDPTAHAEIMA

LRQGGLVMQNYRLIDATLYVTLEPCVMCAGAMIHSRIGRVVFGARDAKTGAAGSLMDVLHHP

GMNHRVEITEGILADECAALLSDFFRMRRQEIKAQKKAQSSTDSGGSSGGSSGSETPGTSES

ATPESSGGSSGGSSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIGRVVFGVRNAKTG

AAGSLMDVLHYPGMNHRVEITEGILADECAALLCYFFRMPRQVENAQKKAQSSTDSGGSSGG

SSGSETPGTSESATPESSGGSSGGSDKKYSIGLAIGTNSVGWAVITDEYKVPSKKEKVLGNT

DRHSIKKNLIGALLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKADLRLIYLALAHMI

KFRGHFLIEGDLNPDNSDVDKLFIQLVQTYNQLFEENPINASGVDAKAILSARLSKSRRLEN

LIAQLPGEKKNGLFGNLIALSLGLTPNFKSNFDLAEDAKLQLSKDTYDDDLDNLLAQIGDQY

ADLFLAAKNLSDAILLSDILRVNTEITKAPLSASMIKRYDEHHQDLTLLKALVRQQLPEKYK

EIFFDQSKNGYAGYIDGGASQEEFYKFIKPILEKMDGTEELLVKLNREDLLRKQRTEDNGSI

PHQIHLGELHAILRRQEDFYPFLKDNREKIEKILTFRIPYYVGPLARGNSRFAWMTRKSEET

ITPWNFEEVVDKGASAQSFIERMTNFDKNLPNEKVLPKHSLLYEYFTVYNELTKVKYVTEGM

RKPAFLSGEQKKAIVDLLFKTNRKVTVKQLKEDYFKKIECFDCLSYDTEILTVEYGFLPIGK

IVEERIECTVYTVDKNGFVYTQPIAQWHNRGEQEVFEYCLEDGSIIRATKDHKEMTTDGQML

PIDEIFERGLDLKQVDGLP

ABE7.10_Cfa-N_Split_A589C:
(SEQ ID NO: 175)
MSEVEFSHEYWMRHALTLAKRAWDEREVPVGAVLVHNNRVIGEGWNRPIGRHDPTAHAEIMA

LRQGGLVMQNYRLIDATLYVTLEPCVMCAGAMIHSRIGRVVEGARDAKTGAAGSLMDVLHHP

GMNHRVEITEGILADECAALLSDFFRMRRQEIKAQKKAQSSTDSGGSSGGSSGSETPGTSES

ATPESSGGSSGGSSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIGRVVFGVRNAKTG

AAGSLMDVLHYPGMNHRVEITEGILADECAALLCYFFRMPRQVENAQKKAQSSTDSGGSSGG

SSGSETPGTSESATPESSGGSSGGSDKKYSIGLAIGTNSVGWAVITDEYKVPSKKFKVLGNT

DRHSIKKNLIGALLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKADLRLIYLALAHMI

KFRGHFLIEGDLNPDNSDVDKLFIQLVQTYNQLFEENPINASGVDAKAILSARLSKSRRLEN

LIAQLPGEKKNGLFGNLIALSLGLTPNFKSNFDLAEDAKLQLSKDTYDDDLDNLLAQIGDQY

```
ADLFLAAKNLSDAILLSDILRVNTEITKAPLSASMIKRYDEHHQDLTLLKALVRQQLPEKYK

EIFFDQSKNGYAGYIDGGASQEEFYKFIKPILEKMDGTEELLVKLNREDLLRKQRTEDNGSI

PHQIHLGELHAILRRQEDFYPELKDNREKIEKILTFRIPYYVGPLARGNSRFAWMTRKSEET

ITPWNFEEVVDKGASAQSFIERMTNFDKNLPNEKVLPKHSLLYEYFTVYNELTKVKYVTEGM

RKPAFLSGEQKKAIVDLLFKTNRKVTVKQLKEDYFKKIECFDSVEISGVEDRENCLSYDTEI

LTVEYGFLPIGKIVEERIECTVYTVDKNGFVYTQPIAQWHNRGEQEVFEYCLEDGSIIRATK

DHKFMTTDGQMLPIDEIFERGLDLKQVDGLP

ABE7.10_Cfa-N_Split_S590C:
                                                      (SEQ ID NO: 176)
MSEVEFSHEYWMRHALTLAKRAWDEREVPVGAVLVHNNRVIGEGWNRPIGRHDPTAHAEIMA

LRQGGLVMQNYRLIDATLYVTLEPCVMCAGAMIHSRIGRVVEGARDAKTGAAGSLMDVLHHP

GMNHRVEITEGILADECAALLSDFFRMRRQEIKAQKKAQSSTDSGGSSGGSSGSETPGTSES

ATPESSGGSSGGSSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIGRVVFGVRNAKTG

AAGSLMDVLHYPGMNHRVEITEGILADECAALLCYFFRMPRQVENAQKKAQSSTDSGGSSGG

SSGSETPGTSESATPESSGGSSGGSDKKYSIGLAIGTNSVGWAVITDEYKVPSKKFKVLGNT

DRHSIKKNLIGALLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKADLRLIYLALAHMI

KFRGHFLIEGDLNPDNSDVDKLFIQLVQTYNQLFEENPINASGVDAKAILSARLSKSRRLEN

LIAQLPGEKKNGLFGNLIALSLGLTPNFKSNFDLAEDAKLQLSKDTYDDDLDNLLAQIGDQY

ADLFLAAKNLSDAILLSDILRVNTEITKAPLSASMIKRYDEHHQDLTLLKALVRQQLPEKYK

EIFFDQSKNGYAGYIDGGASQEEFYKFIKPILEKMDGTEELLVKLNREDLLRKQRTEDNGSI

PHQIHLGELHAILRRQEDFYPFLKDNREKIEKILTFRIPYYVGPLARGNSRFAWMTRKSEET

ITPWNFEEVVDKGASAQSFIERMTNEDKNLPNEKVLPKHSLLYEYFTVYNELTKVKYVTEGM

RKPAFLSGEQKKAIVDLLFKTNRKVTVKQLKEDYFKKIECFDSVEISGVEDRENACLSYDTE

ILTVEYGFLPIGKIVEERIECTVYTVDKNGFVYTQPIAQWHNRGEQEVFEYCLEDGSIIRAT

KDHKFMTTDGQMLPIDEIFERGLDLKQVDGLP

ABE7.10_Cfa(GEP)-C_Split_S303C:
                                                      (SEQ ID NO: 177)
MVKIISRKSIGTQNVYDIGVGEPHNELLKNGIVASNCDILRVNTEITKAPISASMIKRYDEH

HQDLTILKALVRQQLPEKYKEIFFDQSKNGYAGYIDGGASQEEFYKFIKPILEKMDGTEELL

VKLNREDLLRKQRTFDNGSIPHQIHIGELHAILRRQEDFYPFLKDNREKIEKILTFRIPYYV

GPLARGNSRFAWMIRKSEETITPWNFEEVVDKGASAQSFIERMTNEDKNLPNEKVLPKHSLL

YEYFTVYNELTKVKYVTEGMRKPAFLSGEQKKAIVDLLFKTNRKVTVKQLKEDYFKKIECED

SVEISGVEDRENASIGTYHDLLKIIKDKDELDNEENEDILEDIVITLTIFEDREMIEERLKT

YAHLFDDKVMKQLKRRRYTGWGRISRKLINGIRDKQSGKTILDELKSDGFANRNFMQLIHDD

SITEKEDIQKAQVSGQGDSLHEHIANLAGSPAIKKGILQTVKVVDELVKVMGRHKPENIVIE

MARENQTTQKGQKNSRERMKRIEEGIKELGSQILKEHPVENTQLQNEKLYLYYLQNGRDMYV

DQELDINRLSDYDVDHIVPQSFLKDDSIDNKVLIRSDKNRGKSDNVPSEEVVKKMKNYWRQL

LNAKLITQRKEDNITKAERGGLSELDKAGFIKRQLVETRQITKHVAQILDSRMNTKYDENDK

LIREVKVITLKSKLVSDERKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGETGEI
```

-continued

VWDKGRDFATVRKVLSMPQVNIVKKTEVQTGGESKESILPKRNSDKLIARKKDWDPKKYGGE

DSPTVAYSVLVVAKVEKGKSKKLKSVKELLGITIMERSSFEKNPIDELEAKGYKEVKKDLII

KLPKYSLFELENGRKRMLASAGELQKGNELALPSKYVNFLYLASHYEKLKGSPEDNEQKQLF

VEQHKHYLDEIIEQISEFSKRVILADANLDKVLSAYNKARDKPIREQAENIIHLFTLINLGA

PAAFKYFDTTIDRKRYTSTKEVLDATLIHQSITGLYETRIDLSQLGGDEGADKRTADGSEFE

SPKKKRKV

ABE7.10_Cfa(GEP)-C_Split_T310C:
(SEQ ID NO: 178)
MVKIISRKSLGTQNVYDIGVGEPHNFLLKNGIVASNCEITKAPLSASMIKRYDEHHQDLTLL

KALVRQQLPEKYKEIFFDQSKNGYAGYIDGGASQEEFYKFIKPILEKMDGTEELLVKLNRED

LLRKQRTFDNGSIPHQIHLGELHAILRRQEDFYPFLKDNREKIEKILTFRIPYYVGPLARGN

SRFAWMIRKSEETITPWNFEEVVDKGASAQSFIERMTNFDKNIPNEKVIPKHSLLYEYFTVY

NELTKVKYVTEGMRKPAFLSGEQKKAIVDLLFKTNRKVTVKQLKEDYFKKIECFDSVEISGV

EDRENASIGTYHDLLKIIKDKDELDNEENEDILEDIVLTLTLFEDREMIEERLKTYAHLEDD

KVMKQLKRRRYTGWGRLSRKLINGIRDKQSGKTILDFLKSDGFANRNEMQLIHDDSLTFKED

IQKAQVSGQGDSLHEHIANLAGSPAIKKGILQTVKVVDELVKVMGRHKPENIVIEMARENOT

TQKGQKNSRERMKRIBEGIKELGSQILKEHPVENTQLQNEKLYLYYLQNGRDMYVDQELDIN

RLSDYDVDHIVPQSFLKDDSIDNKVITRSDKNRGKSDNVPSEEVVKKMKNYWRQLLNAKLIT

QRKFDNITKAERGGISELDKAGFIKRQLVETRQITKHVAQILDSRMNTKYDENDKLIREVKV

ITLKSKLVSDERKDFQFYKVREINNYHHAHDAYINAVVGTALIKKYPKLESEFVYGDYKVYD

VRKMIAKSEQEIGKATAKYFFYSNIMNFFKTEITLANGEIRKRPLIEINGETGEIVWDKGRD

FATVRKVISMPQVNIVKKTEVQTGGESKESILPKRNSDKLIARKKDWDPKKYGGEDSPTVAY

SVLVVAKVEKGKSKKLKSVKELIGITIMERSSFEKNPIDELEAKGYKEVKKDLIIKIPKYSL

FELENGRKRMLASAGELQKGNELALPSKYVNELYLASHYEKLKGSPEDNEQKQLFVEQHKHY

LDEIIEQISEFSKRVILADANLDKVISAYNKHRDKPIREQAENIIHLFILINIGAPAAFKYE

DTTIDRKRYTSTKEVLDATLIHQSITGLYETRIDLSQLGGDEGADKRTADGSEFESPKKKRK

V

ABE7.10_Cfa(GEP)-C_Split_T313C:
(SEQ ID NO: 179)
MVKIISRKSIGTQNVYDIGVGEPHNELLKNGIVASNCKAPLSASMIKRYDEHHQDLTLLKAL

VRQQLPEKYKEIFFDQSKNGYAGYIDGGASQEEFYKFIKPILEKMDGTEELLVKINREDLER

KQRTFDNGSIPHQIHLGELHAILRRQEDFYPFLKDNREKIEKILTFRIPYYVGPLARGNSRE

AWMTRKSEETITPWNFEEVVDKGASAQSFIERMTNEDKNIPNEKVLPKHSLLYEYFTVYNEL

TKVKYVTEGMRKPAFLSGEQKKAIVDLLEKTNRKVTVKQLKEDYFKKIECFDSVEISGVEDR

FNASLGTYHDLLKIIKDKDFLDNEENEDILEDIVLTLTLFEDREMIEERLKTYAHLEDDKVM

KQLKRRRYTGWGRLSRKLINGIRDKQSGKTILDELKSDGFANRNEMQLIHDDSLTFKEDIQK

AQVSGQGDSLHEHIANLAGSPAIKKGILQTVKVVDELVKVMGRHKPENIVIEMARENOTTQK

GQKNSRERMKRIEEGIKELGSQILKEHPVENTQLQNEKLYLYYLQNGRDMYVDQELDINRLS

DYDVDHIVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREVKVITI

KSKLVSDERKDFQFYKVREINNYHHAHDAYLNAVVGTALIKKYPKLESEFVYGDYKVYDVRK

MIAKSEQEIGKATAKYFFYSNIMNFFKTEITLANGEIRKRPLIEINGETGEIVWDKGRDFAT

VRKVLSMPQVNIVKKTEVQTGGFSKESILPKRNSDKLIARKKDWDPKKYGGEDSPTVAYSVI

-continued

VVAKVEKGKSKKIKSVKELLGITIMERSSFEKNPIDFLEAKGYKEVKKDLIIKLPKYSLFEL

ENGRKRMLASAGELQKGNELALPSKYVNFLYLASHYEKLKGSPEDNEQKQLFVEQHKHYLDE

IIEQISEFSKRVILADANLDKVLSAYNKHRDKPIREQAENIIHLFTLTNLGAPAAFKYEDTT

IDRKRYTSTKEVIDATLIHQSITGLYETRIDLSQLGGDEGADKRTADGSEFESPKKKRKV

ABE7.10_Cfa(GEP)-C_Split3355C:
(SEQ ID NO: 180)
MVKIISRKSIGTQNVYDIGVGEPHNFLLKNGLVASNCKNGYAGYIDGGASQEEFYKFIKPIL

EKMDGTEELLVKINREDLLRKQRTEDNGSIPHQIHLGELHAILRRQEDFYPFLKDNREKIEK

ILTFRIPYYVGPLARGNSRFAWMIRKSEETITPWNFEEVVDKGASAQSFIERMTNEDKNLPN

EKVIPKHSLLYEYFTVYNELTKVKYVTEGMRKPAFLSGEQKKAIVDLLFKINRKVTVKQLKE

DYFKKIECFDSVEISGVEDRENASIGTYHDLIKIIKDKDELDNEENEDILEDIVITLTLFED

REMIEERLKTYAHLFDDKVMKQLKRRRYTGWGRISRKLINGIRDKQSGKTILDFLKSDGFAN

RNEMQLIHDDSLTFKEDIQKAQVSGQGDSLHEHIANLAGSPAIKKGILQTVKVVDELVKVMG

RHKPENIVIEMARENOTTQKGQKNSRERMKRIEEGIKELGSQILKEHPVENTQLQNEKLYLY

YLQNGRDMYVDQELDINRISDYDVDHIVPQSFLKDDSIDNKVLTRSDKNRGKSDNVPSEEVV

KKMKNYWRQLINAKLITQRKEDNITKAERGGLSELDKAGFIKRQLVETRQITKHVAQILDSR

MNTKYDENDKLIREVKVITLKSKLVSDERKDFQFYKVREINNYHHAHDAYINAVVGTALIKK

YPKLESEFVYGDYKVYDVRKMIAKSEQEIGKATAKYFFYSNIMNFFKTEITLANGEIRKRPL

IETNGETGEIVWDKGRDFATVRKVLSMPQVNIVKKTEVQTGGESKESILPKRNSDKLIARKK

DWDPKKYGGFDSPTVAYSVLVVAKVEKGKSKKLKSVKELLGITIMERSSFEKNPIDFLEAKG

YKEVKKDLIIKLPKYSIFELENGRKRMLASAGELQKGNELALPSKYVNFLYLASHYEKLKGS

PEDNEQKQLFVEQHKHYLDEIIEQISEFSKRVILADANLDKVLSAYNKHRDKPIREQAENII

HLFTLTNLGAPAAFKYEDTTIDRKRYTSTKEVLDATLIHQSITGLYETRIDLSQLGGDEGAD

KRTADGSEFESPKKKRKV

ABE7.10_Cfa(GEP)-C_Split_A456C:
(SEQ ID NO: 181)
MVKIISRKSLGTQNVYDIGVGEPHNFLLKNGLVASNCRGNSRFAWMTRKSEETITPWNFEEV

VDKGASAQSFIERMINFDKNLPNEKVLPKHSLLYEYFTVYNELTKVKYVTEGMRKPAFLSGE

QKKAIVDLLFKTNRKVTVKQLKEDYFKKIECFDSVEISGVEDRENASLGTYHDLLKIIKDKD

FLDNEENEDILEDIVLTLTLFEDREMIEERLKTYAHLEDDKVMKQLKRRRYTGWGRLSRKLI

NGIRDKQSGKTILDELKSDGFANRNFMQLIHDDSLTFKEDIQKAQVSGQGDSLHEHIANLAG

SPAIKKGILQTVKVVDELVKVMGRHKPENIVIEMARENOTTQKGQKNSRERMKRIEEGIKEL

GSQILKEHPVENTQLQNEKLYLYYLQNGRDMYVDQELDINRLSDYDVDHIVPQSFLKDDSID

NKVLTRSDKNRGKSDNVPSEEVVKKMKNYWRQLLNAKLITQRKEDNITKAERGGLSELDKAG

FIKRQLVETRQITKHVAQILDSRMNTKYDENDKLIREVKVITIKSKLVSDERKDFQFYKVRE

INNYHHAHDAYLNAVVGTALIKKYPKLESEFVYGDYKVYDVRKMIAKSEQEIGKATAKYFFY

SNIMNFFKTEITLANGEIRKRPLIETNGETGEIVWDKGRDFATVRKVLSMPQVNIVKKTEVQ

TGGESKESILPKRNSDKLIARKKDWDPKKYGGFDSPTVAYSVIVVAKVEKGKSKKLKSVKEL

LGITIMERSSFEKNPIDFLEAKGYKEVKKDLIIKLPKYSLFELENGRKRMLASAGELQKGNE

LALPSKYVNFLYLASHYEKLKGSPEDNEQKQLFVEQHKHYLDEIIEQISEFSKRVILADANI

DKVLSAYNKHRDKPIREQAENIIHLFTLINLGAPAAFKYFDTTIDRKRYTSTKEVLDATLIH

QSITGLYETRIDISQLGGDEGADKRTADGSEFESPKKKRKV

-continued

ABE7.10_Cfa(GEP)-C_Split_S460C:
(SEQ ID NO: 182)
MVKIISRKSIGTQNVYDIGVGEPHNFLLKNGLVASNCRFAWMTRKSEETITPWNFEEVVDKG

ASAQSFIERMINEDKNIPNEKVLPKHSLLYEYFTVYNELTKVKYVTEGMRKPAFLSGEQKKA

IVDLLFKTNRKVTVKQLKEDYFKKIECEDSVEISGVEDRENASIGTYHDLIKIIKDKDELDN

EENEDILEDIVLTITLFEDREMIEERLKTYAHLFDDKVMKQLKRRRYTGWGRISRKLINGIR

DKQSGKTILDELKSDGFANRNEMQLIHDDSLTFKEDIQKAQVSGQGDSLHEHIANLAGSPAI

KKGILQTVKVVDELVKVMGRHKPENIVIEMARENOTTQKGQKNSRERMKRIEEGIKELGSQI

LKEHPVENTQLQNEKLYLYYLQNGRDMYVDQELDINRISDYDVDHIVPQSELKDDSIDNKVL

TRSDKNRGKSDNVPSEEVVKKMKNYWRQLINAKLITQRKEDNITKAERGGLSELDKAGFIKR

QLVETRQITKHVAQILDSRMNTKYDENDKLIREVKVITLKSKIVSDERKDFQFYKVREINNY

HHAHDAYINAVVGTALIKKYPKLESEFVYGDYKVYDVRKMIAKSEQEIGKATAKYFFYSNIM

NFFKTEITLANGEIRKRPLIETNGETGEIVWDKGRDFATVRKVISMPQVNIVKKTEVQTGGE

SKESILPKRNSDKLIARKKDWDPKKYGGFDSPTVAYSVLVVAKVEKGKSKKLKSVKELLGIT

IMERSSFEKNPIDFLEAKGYKEVKKDLIIKLPKYSLFELENGRKRMLASAGELQKGNELALP

SKYVNFLYLASHYEKLKGSPEDNEQKQLFVEQHKHYLDEIIEQISEFSKRVILADANLDKVL

SAYNKHRDKPIREQAENIIHLFTLINIGAPAAFKYEDTTIDRKRYTSTKEVLDATLIHQSIT

GLYETRIDLSQLGGDEGADKRTADGSEFESPKKKRKV

ABE7.10_Cfa(GEP)-C_Split_A463C:
(SEQ ID NO: 183)
MVKIISRKSIGTQNVYDIGVGEPHNFLLKNGLVASNCWMIRKSEETITPWNFEEVVDKGASA

QSFIERMINEDKNLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKIIKDKDELDNEEN

EDILEDIVITITLFEDREMIEERIKTYAHLFDDKVMKQLKRRRYTGWGRLSRKLINGIRDKQ

SGKTILDFLKSDGFANRNFMQLIHDDSLTFKEDIQKAQVSGQGDSLHEHIANLAGSPAIKKG

ILQTVKVVDELVKVMGRHKPENIVIEMARENOTTQKGQKNSRERMKRIEEGIKELGSQILKE

HPVENTQLQNEKLYLYYLQNGRDMYVDQELDINRLSDYDVDHIVPQSFLKDDSIDNKVLTRS

DKNRGKSDNVPSEEVVKKMKNYWRQLLNAKLITQRKEDNLTKAERGGLSELDKAGFIKRQLV

ETRQITKHVAQILDSRMNTKYDENDKLIREVKVITLKSKLVSDERKDFQFYKVREINNYHHA

HDAYLNAVVGTALIKKYPKLESEFVYGDYKVYDVRKMIAKSEQEIGKATAKYFFYSNIMNFF

KTEITLANGEIRKRPLIEINGETGEIVWDKGRDFATVRKVLSMPQVNIVKKTEVQTGGFSKE

SILPKRNSDKLIARKKDWDPKKYGGFDSPTVAYSVLVVAKVEKGKSKKLKSVKELLGITIME

RSSFEKNPIDFLEAKGYKEVKKDLIIKLPKYSLFELENGRKRMLASAGELQKGNELALPSKY

VNFLYLASHYEKLKGSPEDNEQKQLFVEQHKHYLDEIIEQISEFSKRVILADANLDKVLSAY

NKHRDKPIREQAENIIHLFTLINIGAPAAFKYFDTTIDRKRYTSTKEVIDATLIHQSITGLY

ETRIDLSQLGGDEGADKRTADGSEFESPKKKRKV

ABE7.10_Cfa(GEP)-C_Split_T446C:
(SEQ ID NO: 184)
MVKIISRKSIGTQNVYDIGVGEPHNELLKNGIVASNCRKSEETITPWNFEEVVDKGASAQSE

IERMINEDKNIPNEKVIPKHSLLYEYFTVYNELTKVKYVTEGMRKPAFLSGEQKKAIVDLLE

KTNRKVTVKQLKEDYFKKIECFDSVEISGVEDRFNASIGTYHDLLKIIKDKDELDNEENEDI

LEDIVITLTIFEDREMIEERLKTYAHLEDDKVMKQLKRRRYTGWGRLSRKLINGIRDKQSGK

TILDFLKSDGFANRNFMQLIHDDSLTFKEDIQKAQVSGQGDSLHEHIANLAGSPAIKKGILQ

TVKVVDELVKVMGRHKPENIVIEMARENOTTQKGQKNSRERMKRIEEGIKELGSQILKEHPV

```
ENTQLQNEKLYLYYLQNGRDMYVDQELDINRISDYDVDHIVPQSELKDDSIDNKVLTRSDKN

RGKSDNVPSEEVVKKMKNYWRQLINAKLITQRKEDNLTKAERGGLSELDKAGFIKRQLVETR

QITKHVAQILDSRMNTKYDENDKLIREVKVITLKSKLVSDERKDFQFYKVREINNYHHAHDA

YILNAVVGTALIKKYPKLESEFVYGDYKVYDVRKMIAKSEQEIGKATAKYFFYSNIMNFFKTE

ITLANGEIRKRPLIETNGETGEIVWDKGRDFATVRKVLSMPQVNIVKKTEVQTGGESKESIL

PKRNSDKLIARKKDWDPKKYGGFDSPTVAYSVLVVAKVEKGKSKKLKSVKELLGITIMERSS

FEKNPIDFLEAKGYKEVKKDLIIKLPKYSLFELENGRKRMLASAGELQKGNELALPSKYVNE

LYLASHYEKLKGSPEDNEQKQLFVEQHKHYLDEIIEQISEFSKRVILADANLDKVLSAYNKH

RDKPIREQAENIIHLFTLTNLGAPAAFKYEDTTIDRKRYTSTKEVLDATLIHQSITGLYETR

IDLSQLGGDEGADKRTADGSEFESPKKKRKV
```

ABE7.10_Cfa(GEP)-C_Split_T469C:
                                                                (SEQ ID NO: 185)
```
MVKIISRKSLGTQNVYDIGVGEPHNFLLKNGLVASNCEETITPWNFEEVVDKGASAQSFIER

MTNFDKNLPNEKVLPKHSLLYEYFTVYNELTKVKYVTEGMRKPAFLSGEQKKAIVDLLFKTN

RKVTVKQLKEDYFKKIECFDSVEISGVEDRENASLGTYHDLLKIIKDKDELDNEENEDILED

IVLTLTIFEDREMIEERLKTYAHLFDDKVMKQLKRRRYTGWGRLSRKLINGIRDKQSGKTIL

DELKSDGFANRNEMQLIHDDSLTFKEDIQKAQVSGQGDSLHEHIANLAGSPAIKKGILQTVK

VVDELVKVMGRHKPENIVIEMARENOTTQKGQKNSRERMKRIEEGIKELGSQILKEHPVENT

QLQNEKLYLYYLQNGRDMYVDQELDINRLSDYDVDHIVPQSFLKDDSIDNKVLTRSDKNRGK

SDNVPSEEVVKKMKNYWRQLLNAKLITQRKEDNITKAERGGLSELDKAGFIKRQLVETRQIT

KHVAQILDSRMNTKYDENDKLIREVKVITIKSKLVSDERKDFQFYKVREINNYHHAHDAYIN

AVVGTALIKKYPKLESEFVYGDYKVYDVRKMIAKSEQEIGKATAKYFFYSNIMNFFKTEITE

ANGEIRKRPLIEINGETGEIVWDKGRDFATVRKVLSMPQVNIVKKTEVQTGGFSKESILPKR

NSDKLIARKKDWDPKKYGGFDSPTVAYSVIVVAKVEKGKSKKIKSVKELLGITIMERSSFEK

NPIDFLEAKGYKEVKKDLIIKLPKYSLFELENGRKRMLASAGELQKGNELALPSKYVNELYL

ASHYEKLKGSPEDNEQKQLFVEQHKHYLDEIIEQISEFSKRVILADANIDKVISAYNKHRDK

PIREQAENIIHLETITNLGAPAAFKYEDTTIDRKRYTSTKEVIDATLIHQSITGLYETRIDL

SQLGGDEGADKRTADGSEFESPKKKRKV
```

ABE7.10_Cfa(GEP)-C_Split_T472C:
                                                                (SEQ ID NO: 186)
```
MVKIISRKSIGTQNVYDIGVGEPHNELLKNGIVASNCITPWNFEEVVDKGASAQSFIERMTN

FDKNLPNEKVIPKHSLLYEYFTVYNELTKVKYVTEGMRKPAFLSGEQKKAIVDLLFKTNRKV

TVKQLKEDYFKKIECFDSVEISGVEDRENASIGTYHDLLKIIKDKDELDNEENEDILEDIVL

TITLFEDREMIEERIKTYAHLEDDKVMKQLKRRRYTGWGRLSRKLINGIRDKQSGKTILDEL

KSDGFANRNFMQLIHDDSITEKEDIQKAQVSGQGDSLHEHIANLAGSPAIKKGILQTVKVVD

ELVKVMGRHKPENIVIEMARENOTTQKGQKNSRERMKRIEEGIKELGSQILKEHPVENTQLQ

NEKLYLYYLQNGRDMYVDQELDINRLSDYDVDHIVPQSFLKDDSIDNKVLTRSDKNRGKSDN

VPSEEVVKKMKNYWRQLLNAKLITQRKEDNLTKAERGGLSELDKAGFIKRQLVETRQITKHV

AQILDSRMNTKYDENDKLIREVKVITLKSKLVSDERKDFQFYKVREINNYHHAHDAYLNAVV

GTALIKKYPKLESEFVYGDYKVYDVRKMIAKSEQEIGKATAKYFFYSNIMNFFKTEITLANG

EIRKRPLIETNGETGEIVWDKGRDFATVRKVLSMPQVNIVKKTEVQTGGFSKESILPKRNSD

KLIARKKDWDPKKYGGFDSPTVAYSVLVVAKVEKGKSKKLKSVKELLGITIMERSSFEKNPI
```

-continued

DFLEAKGYKEVKKDLIIKLPKYSLFELENGRKRMLASAGELQKGNELALPSKYVNFLYLASH

YEKLKGSPEDNEQKQLFVEQHKHYLDEIIEQISEFSKRVILADANLDKVLSAYNKARDKPIR

BQAENIIHIFTLINLGAPAAFKYFDTTIDRKRYTSTKEVLDATLIHQSITGLYETRIDLSQL

GGDEGADKRTADGSEFESPKKKRKV

ABE7.10_Cfa(GEP)-C_Split_T474C:
(SEQ ID NO: 187)
MVKIISRKSLGTQNVYDIGVGEPHNFLLKNGIVASNCPWNFEEVVDKGASAQSFIERMINED

KNLPNEKVIPKHSLLYEYFTVYNELIKVKYVTEGMRKPAFLSGEQKKAIVDLLFKTNRKVTV

KQLKEDYFKKIECFDSVEISGVEDRENASIGTYHDLLKIIKDKDFLDNEENEDILEDIVLTL

TLFEDREMIEERIKTYAHLFDDKVMKQLKRRRYTGWGRLSRKLINGIRDKQSGKTILDELKS

DGFANRNFMQLIHDDSLTFKEDIQKAQVSGQGDSLHEHIANLAGSPAIKKGILQTVKVVDEL

VKVMGRHKPENIVIEMARENQTTQKGQKNSRERMKRIEEGIKELGSQILKEHPVENTQLQNE

KLYLYYLQNGRDMYVDQELDINRISDYDVDHIVPQSFLKDDSIDNKVLTRSDKNRGKSDNVP

SEEVVKKMKNYWRQLLNAKLITQRKEDNLTKAERGGLSELDKAGFIKRQLVETRQITKHVAQ

ILDSRMNTKYDENDKLIREVKVITLKSKLVSDERKDFQFYKVREINNYHHAHDAYLNAVVGT

ALIKKYPKLESEFVYGDYKVYDVRKMIAKSEQEIGKATAKYFFYSNIMNFFKTEITLANGEI

RKRPLIETNGETGEIVWDKGRDFATVRKVISMPQVNIVKKTEVQTGGFSKESILPKRNSDKL

IARKKDWDPKKYGGFDSPTVAYSVLVVAKVEKGKSKKIKSVKELLGITIMERSSFEKNPIDE

LEAKGYKEVKKDLIIKIPKYSLFELENGRKRMLASAGELQKGNELALPSKYVNFLYLASHYE

KIKGSPEDNEQKQLFVEQHKHYLDEIIEQISEFSKRVILADANLDKVLSAYNKHRDKPIREQ

AENIIHIFTLINIGAPAAFKYFDTTIDRKRYTSTKEVIDATLIHQSITGLYETRIDISQLGG

DEGADKRTADGSEFESPKKKRKV

ABE7.10_Cfa(GEP)-C_Split_C574C:
(SEQ ID NO: 188)
MVKIISRKSIGTQNVYDIGVGEPHNELLKNGIVASNCFDSVEISGVEDRENASLGTYHDLIK

IIKDKDELDNEENEDILEDIVLTITLFEDREMIEERLKTYAHLEDDKVMKQLKRRRYTGWGR

LSRKLINGIRDKQSGKTILDELKSDGFANRNFMQLIHDDSLTFKEDIQKAQVSGQGDSLHEH

IANLAGSPAIKKGILQTVKVVDELVKVMGRHKPENIVIEMARENQTTQKGQKNSRERMKRIE

EGIKELGSQILKEHPVENTQLQNEKLYLYYLQNGRDMYVDQELDINRLSDYDVDHIVPQSFI

KDDSIDNKVLTRSDKNRGKSDNVPSEEVVKKMKNYWRQLINAKLITQRKFDNITKAERGGLS

ELDKAGFIKRQLVETRQITKHVAQILDSRMNTKYDENDKLIREVKVITLKSKLVSDERKDFQ

FYKVREINNYHHAHDAYLNAVVGTALIKKYPKLESEFVYGDYKVYDVRKMIAKSEQEIGKAT

AKYFFYSNIMNFFKTEITLANGEIRKRPLIETNGETGEIVWDKGRDFATVRKVLSMPQVNIV

KKTEVQTGGFSKESILPKRNSDKLIARKKDWDPKKYGGEDSPTVAYSVIVVAKVEKGKSKKL

KSVKELLGITIMERSSFEKNPIDFLEAKGYKEVKKDLIIKLPKYSLFELENGRKRMLASAGE

LQKGNELALPSKYVNFLYLASHYEKLKGSPEDNEQKQLFVEQHKHYLDEIIEQISEFSKRVI

LADANLDKVLSAYNKHRDKPIREQAENIIHLFTLTNLGAPAAFKYEDTTIDRKRYTSTKEVI

DATLIHQSITGLYETRIDLSQLGGDEGADKRTADGSEFESPKKKRKV

ABE7.10_Cfa(GEP)-C_Split_S577C:
(SEQ ID NO: 189)
MVKIISRKSLGTQNVYDIGVGEPHNFLLKNGIVASNCVEISGVEDRENASIGTYHDLLKIIK

DKDELDNEENEDILEDIVLTLTLFEDREMIEERLKTYAHLFDDKVMKQLKRRRYTGWGRLSR

KLINGIRDKQSGKTILDFLKSDGFANRNFMQLIHDDSLTFKEDIQKAQVSGQGDSLHEHIAN

LAGSPAIKKGILQTVKVVDELVKVMGRHKPENIVIEMARENQTTQKGQKNSRERMKRIEEGI

-continued

KELGSQILKEHPVENTQLQNEKLYLYYLQNGRDMYVDQELDINRISDYDVDHIVPQSFLKDD

SIDNKVITRSDKNRGKSDNVPSEEVVKKMKNYWRQLLNAKLITQRKEDNLTKAERGGLSELD

KAGFIKRQLVETRQITKHVAQILDSRMNTKYDENDKLIREVKVITLKSKLVSDERKDFQFYK

VREINNYHHAHDAYINAVVGTALIKKYPKLESEFVYGDYKVYDVRKMIAKSEQEIGKATAKY

FFYSNIMNFFKTEITLANGEIRKRPLIETNGETGEIVWDKGRDFATVRKVLSMPQVNIVKKT

EVQTGGESKESILPKRNSDKLIARKKDWDPKKYGGFDSPTVAYSVLVVAKVEKGKSKKLKSV

KELLGITIMERSSFEKNPIDFLEAKGYKEVKKDLIIKIPKYSIFELENGRKRMLASAGELQK

GNELALPSKYVNFLYLASHYEKLKGSPEDNEQKQLFVEQHKHYLDEIIEQISEFSKRVILAD

ANLDKVISAYNKHRDKPIREQAENIIHILFTLINIGAPAAFKYEDTTIDRKRYTSTKEVLDAT

LIHQSITGLYETRIDLSQLGGDEGADKRTADGSEFESPKKKRKV

ABE7.10_Cfa(GEP)-C_Split_A589C:
(SEQ ID NO: 190)
MVKIISRKSIGTQNVYDIGVGEPHNELLKNGIVASNCSLGTYHDLLKIIKDKDFLDNEENED

ILEDIVITITIFEDREMIEERLKTYAHLEDDKVMKQLKRRRYTGWGRLSRKLINGIRDKQSG

KTILDELKSDGFANRNFMQLIHDDSLTEKEDIQKAQVSGQGDSLHEHIANLAGSPAIKKGIL

QTVKVVDELVKVMGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDDSIDNKVLTRSDK

NRGKSDNVPSEEVVKKMKNYWRQLINAKLITQRKEDNITKAERGGLSELDKAGFIKRQLVET

RQITKHVAQILDSRMNTKYDENDKLIREVKVITLKSKLVSDERKDFQFYKVREINNYHHAHD

AYLNAVVGTALIKKYPKLESEFVYGDYKVYDVRKMIAKSEQEIGKATAKYFFYSNIMNFFKT

EITLANGEIRKRPLIETNGETGEIVWDKGRDFATVRKVLSMPQVNIVKKTEVQTGGESKESI

LPKRNSDKLIARKKDWDPKKYGGFDSPTVAYSVLVVAKVEKGKSKKLKSVKELLGITIMERS

SFEKNPIDFLEAKGYKEVKKDLIIKLPKYSLFELENGRKRMLASAGELQKGNELALPSKYVN

FLYLASHYEKLKGSPEDNEQKQLFVEQHKHYLDEIIEQISEFSKRVILADANLDKVLSAYNK

HRDKPIREQAENIIHLFTLTNLGAPAAFKYEDTTIDRKRYTSTKEVIDATLIHQSITGLYET

RIDLSQLGGDEGADKRTADGSEFESPKKKRKV

ABE7.10_Cfa(GEP)-C_Split_S590C:
(SEQ ID NO: 191)
MVKIISRKSLGTQNVYDIGVGEPHNFLLKNGIVASNCLGTYHDLLKIIKDKDELDNEENEDI

LEDIVITLTLFEDREMIEERLKTYAHLEDDKVMKQLKRRRYTGWGRLSRKLINGIRDKQSGK

TILDELKSDGFANRNEMQLIHDDSLTFKEDIQKAQVSGQGDSLHEHIANLAGSPAIKKGILQ

TVKVVDELVKVMGRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDSIDNKVLTRSDKN

RGKSDNVPSEEVVKKMKNYWRQLLNAKLITQRKFDNLTKAERGGLSELDKAGFIKRQLVETR

QITKHVAQILDSRMNTKYDENDKLIREVKVITLKSKLVSDERKDFQFYKVREINNYHHAHDA

YLNAVVGTALIKKYPKLESEFVYGDYKVYDVRKMIAKSEQEIGKATAKYFFYSNIMNFFKTE

ITLANGEIRKRPLIETNGETGEIVWDKGRDFATVRKVLSMPQVNIVKKTEVQTGGFSKESIL

PKRNSDKLIARKKDWDPKKYGGFDSPTVAYSVLVVAKVEKGKSKKLKSVKELLGITIMERSS

FEKNPIDFLEAKGYKEVKKDLIIKLPKYSIFELENGRKRMLASAGELQKGNELALPSKYVNF

LYLASHYEKLKGSPEDNEQKQLFVEQHKHYLDEIIEQISEFSKRVILADANLDKVLSAYNKH

RDKPIREQAENIIHIFTLINIGAPAAFKYFDTTIDRKRYTSTKEVIDATLIHQSITGLYETR

IDLSQLGGDEGADKRTADGSEFESPKKKRKV

Figure 5D:
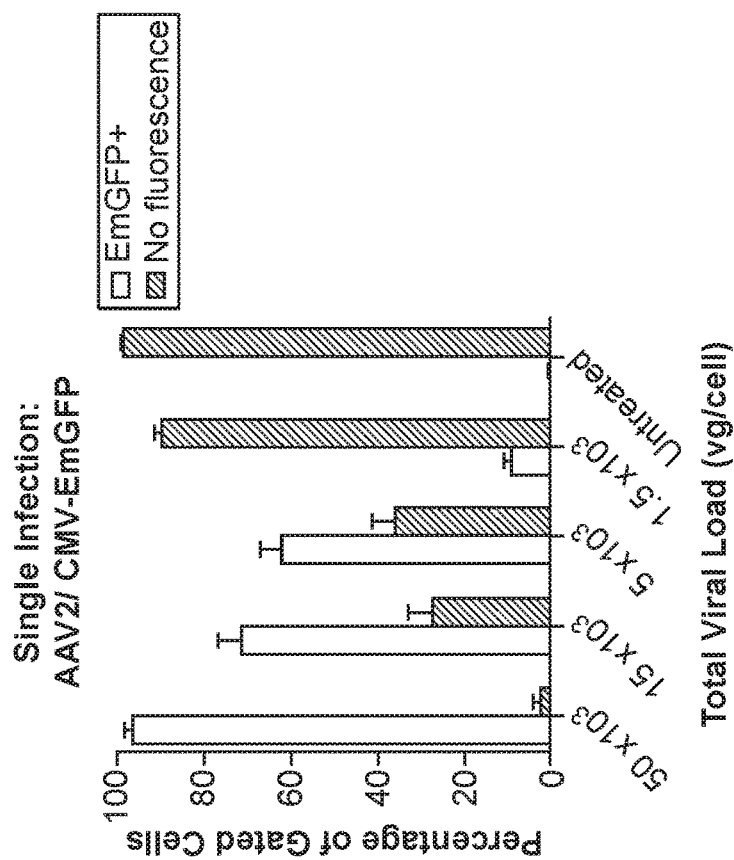
Figure 5C:
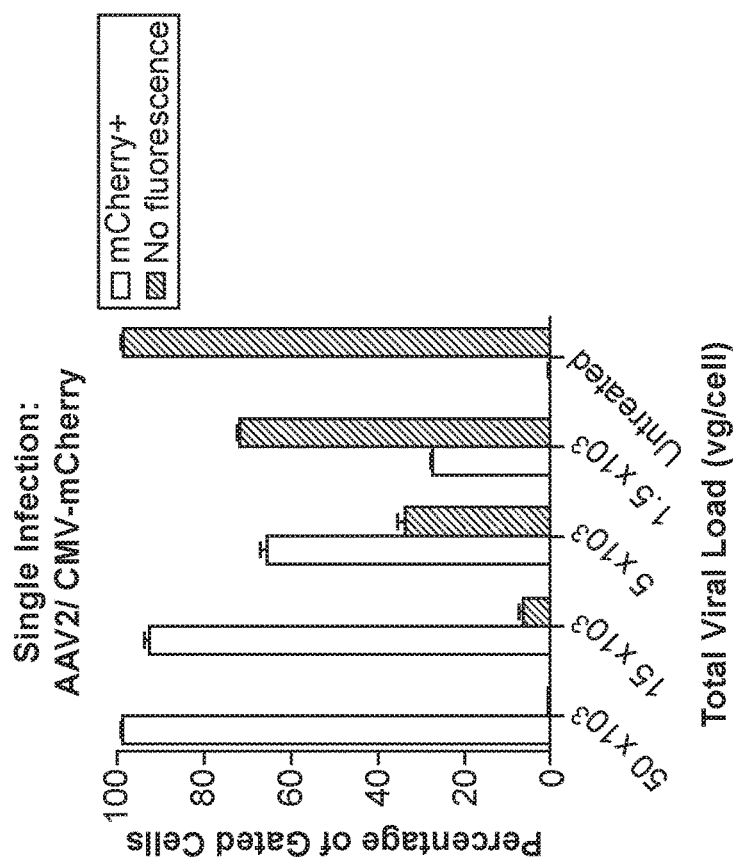

Example 2: Delivery of Split A-to-G Base Editor (ABE) Via Dual AAV Infection Yields High A>G Conversion AAV delivery of a split A-to-G base editor fused to intein-N and intein-C was evaluated, including the ability of split ABE to reassemble and reconstitute base editing activity in co-infected cells. Initial studies were performed using fluorescent reporter constructs to determine optimal multiplicity of infection (MOI) for AAV2 co-infection in retinal cells. AAV2 expression vectors containing CMV-mCherry and CMV-EmGFP were used to monitor co-infections. Flow cytometry revealed optimal MOI for AAV2 co-infection of ARPE-19 cells is 60,000-100,000 vg/cell (FIG. 5A). Fluorescence microscopy at day 3 post co-infection at 60,000 vg/cell showed EmGFP and mCherry co-localization (FIG. 5B). Single infections also showed high numbers of cells (>95%) with fluorescent reporter expression at 50,000 vg/cell for both CMV-mCherry (FIG. 5C) and CMV-EmGFP (FIG. 5D). Percentage of fluorescent cells was dependent on total viral load.

Figure 6:
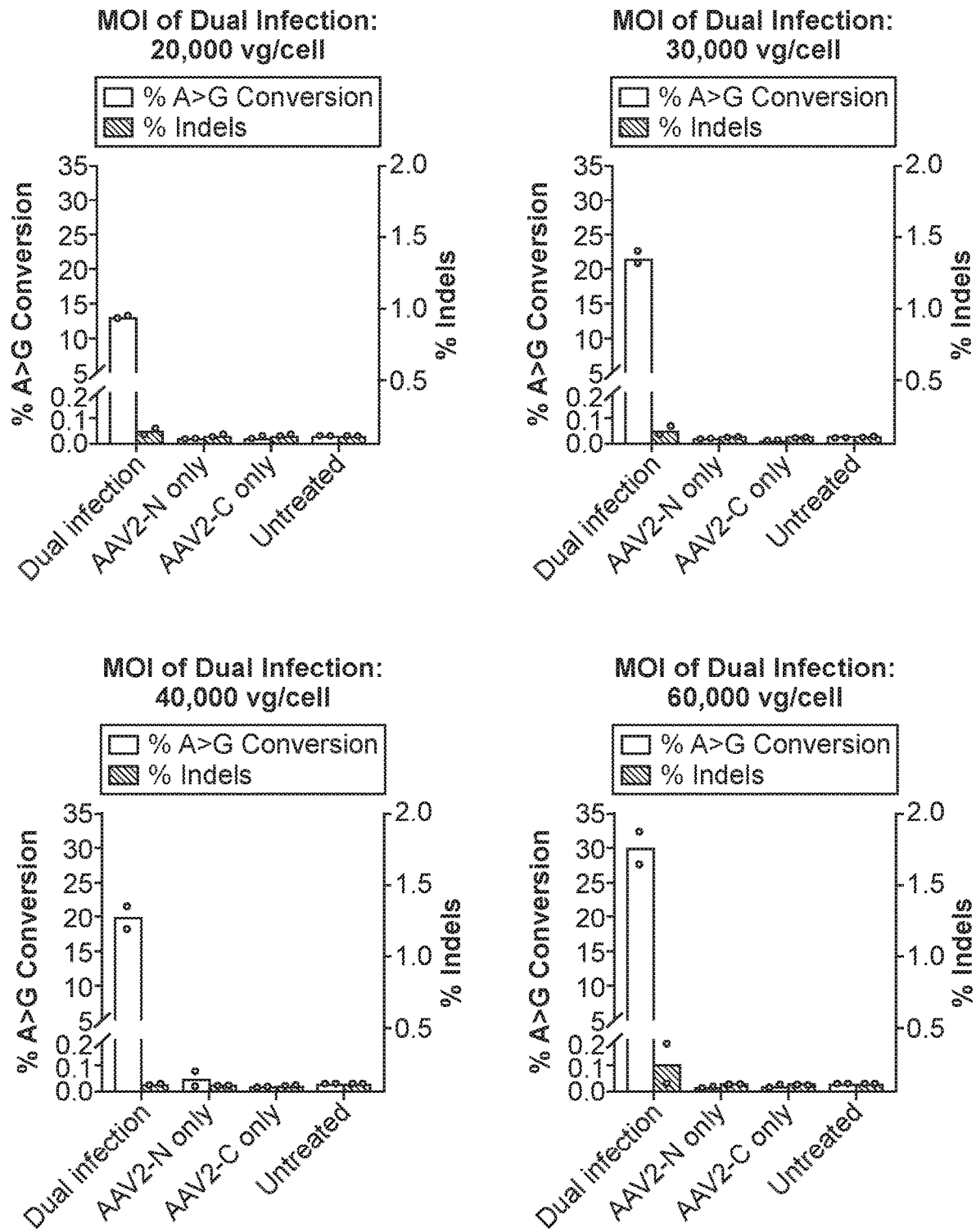
FIG. 6 is a series of graphs showing delivery of split editor to ARPE-19 cells via dual AAV2 infection yields high A>G conversion at ABCA4 5882A. Multiplicity of infection (MOI) of dual infection at 20,000 vg/cell (top, left); 30,000 vg/cell (top, right); 40,000 vg/cell (bottom, left); and 60,000 vg/cell (bottom, right) are shown.

Delivery of split editor to ARPE-19 retinal cells via dual AAV2 infection yielded high A>G conversion at ABCA4 5882A (FIG. 6). In this experiment, ABE split at Cas9 T310 (N-terminus fused to intein-N at Cas9 amino acid position N309 and the C-terminus fused to intein C at Cas9 amino acid position T310) was evaluated. The following constructs were packaged into AAV2 vectors:

AAV2-N: AAV2/PCMV Split_ABE7.10$^{N(T310)}$-Int$^N$-rGpA|P$_{U6}$sgRNA

AAV2-C: AAV2/P$_{CMV}$Int$^C$-Split_ABE7.10$^{C(T310)}$-rGpA according to routine methods for AAV packaging (Viral Vector Core, University of Massachusetts Medical School). Retinal ARPE-19 cells were co-infected with both AAV vectors; infected with each AAV vector singly; or untreated. As shown at various MOIs (dual infection) from 20,000-60,000 vg/cell, A>G conversion was observed at ABCA4 5882A. A>G conversion increased with increasing MOI of dual infection (~13% at 20,000 vg/cell—~30% at 60,000 vg/cell). A>G conversion was accompanied by low levels of (<.1%) indel formation. No A>G conversion at the target site was observed in cells infected with N-or C-terminal fragments alone nor in untreated cells.

OTHER EMBODIMENTS

From the foregoing description, it will be apparent that variations and modifications may be made to the invention described herein to adopt it to various usages and conditions. Such embodiments are also within the scope of the following claims.

The recitation of a listing of elements in any definition of a variable herein includes definitions of that variable as any single element or combination (or subcombination) of listed elements. The recitation of an embodiment herein includes that embodiment as any single embodiment or in combination with any other embodiments or portions thereof.

All patents and publications mentioned in this specification are herein incorporated by reference to the same extent as if each independent patent and publication was specifically and individually indicated to be incorporated by reference.

SEQUENCE LISTING (191 sequences)

SEQ ID NO: 1 - DNA, 4104 bp, Streptococcus pyogenes
atggataagaaatactcaataggcttagatatcggcacaaatagcgtcggatgggcggtgatcactgatgattataaggttccgtctaaaaagttcaaggttctgggaaatacagaccgccacagtatcaaaaaaaatcttataggggctcttttatttggcagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggcagattctactgataaagcggatttgcgcttaatctatttggccttagcgcatatgattaagtttcgtggtcattttttgattgagggagatttaaatcctgataatagtgatgtggacaaactatttatccagttggtacaaatctacaatcaattatttgaagaaaaccctattaacgcaagtagagtagatgctaaagcgattctttctgcacgattgagtaaatcaagacgattagaaaatctcattgctcagctccccggtgagaagagaaatggcttgtttgggaatctcattgctttgtcattgggattgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatagtgaaataactaaggctcccctatcagcttcaatgattaagcgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgagggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggcgcctaccatgatttgctaaaaattattaaagataaagattttttggataatgaagaaaatgaagatatcttagaggatattgttttaacattgaccttatttgaagatagggggatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagatattcaaaaagcacaggtgtctggacaaggccatagtttacatgaacagattgctaacttagctggcagtcctgctattaaaaaaggtattttacagactgtaaaaattgttgatgaactggtcaaagtaatggggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctacaaaatggaagagacatgtatgtggaccaagaattagatattaatcgtttaagtgattatgatgtcgatcacattgttccacaaagtttcattaaagacgattcaatagacaataaggtactaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 2 - protein, 1367 aa, Streptococcus pyogenes
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 3 - protein, 167 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 4 - protein, 178 aa, Escherichia coli
MRRAFITGVFFLSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 5 - protein, 160 aa, Staphylococcus aureus
MGSHMTNDIYFMTLAIEEAKKAAQLGEVPIGAIITKDDEVIARAHNLRETLQQPTAHAEHIAIERAAKVLGSWRLEGCTLYVTLEPCVMCAGTIVMSRIPRVVYGADDPKGGCSGSLMNLLQQSNFNHRAIVDKGVLKEACSTLLTTFFKNLRANKKSTN

SEQ ID NO: 6 - protein, 161 aa, Bacillus subtilis
MTQDELYMKEAIKEAKKAEEKGEVPIGAVLVINGEIIARAHNLRETEQRSIAHAEMLVIDEACKALGTWRLEGATLYVTLEPCPMCAGAVVLSRVEKVVFGAFDPKGGCSGTLMNLLQEERFNHQAEVVSGVLEEECGGMLSAFFRELRKKKKAARKNLSE

SEQ ID NO: 7 - protein, 183 aa, Salmonella typhimurium
MPPAFITGVTSLSDVELDHEYWMRHALTLAKRAWDEREVPVGAVLVHNHRVIGEGWNRPIGRHDPTAHAEIMALRQGGLVLQNYRLLDTTLYVTLEPCVMCAGAMVHSRIGRVVFGARDAKTGAAGSLIDVLHHPGMNHRVEIIEGVLRDECATLLSDFFRMRRQEIKALKKADRAEGAGPAV

SEQ ID NO: 8 - protein, 164 aa, Shewanella putrefaciens
MDEYWMQVAMQMAEKAEAAGEVPVGAVLVKDGQQIATGYNLSISQHDPTAHAEILCLRSAGKKLENYRLLDATLYITLEPCAMCAGAMVHSRIARVVYGARDEKTGAAGTVVNLLQHPAFNHQVEVTSGVLAEACSAQLSRFFKRRRDEKKALKLAQRAQQGIE

SEQ ID NO: 9 - protein, 173 aa, Artificial Sequence
  Description of Artificial Sequence: Synthetic polypeptide
MDAAKVRSEFDEKMMRYALELADKAEALGEIPVGAVLVDDARNIIGEGWNLSIVQSDPTAHAEIIALRNGAKNIQNYRLLNSTLYVTLEPCTMCAGAILHSRIKRLVFGASDYKTGAIGSRFHFFDDYKMNHTLEITSGVLAEECSQKLSTFFQKRREEKKIEKALLKSLSDK

SEQ ID NO: 10 - protein, 161 aa, Caulobacter crescentus
MRTDESEDQDHRMMRLALDAARAAAEAGETPVGAVILDPSTGEVIATAGNGPIAAHDPTAHAEIAAMRAAAAKLGNYRLTDLTLVVTLEPCAMCAGAISHARIGRVVFGADDPKGGAVVHGPKFFAQPTCHWRPEVTGGVLADESADLLRGFFRARRKAKI

SEQ ID NO: 11 - protein, 179 aa, Geobacter sulfurreducens
MSSLKKTPIRDDAYWMGKAIREAAKAAARDEVPIGAVIVRDGAVIGRGHNLREGSNDPSAHAEMIAIRQAARRSANWRLTGATLYVTLEPCLMCMGAIILARLERVVFGCYDPKGGAAGSLYDLSADPRLNHQVRLSPGVCQEECGTMLSDFFRDLRRRKKAKATPALFIDERKVPPEP

SEQ ID NO: 12 - protein, 167 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTD

SEQ ID NO: 13 - DNA, 4212 bp, Artificial Sequence
  Description of Artificial Sequence: Synthetic polynucleotide
atggataaaaagtattctattggtttagacatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccatggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgacggatcccccaagaagaagaggaaagtctcgagcgactacaaagaccatgacggtgattataaagatcatgacatcgattacaaggatgacgatgacaaggctgcagga

SEQ ID NO: 14 - protein, 1368 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 15 - DNA, 4107 bp, Streptococcus pyogenes
atggataagaaatactcaataggcttagatatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatcacattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 16 - protein, 1368 aa, Streptococcus pyogenes [sequence omitted]

SEQ ID NO: 17 - protein, 1368 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 18 - protein, 1367 aa, Artificial Sequence
  Description of Artificial Sequence: Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 19 - protein, 1367 aa, Artificial Sequence
  Description of Artificial Sequence: Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 20 - protein, 1367 aa, Artificial Sequence
  Description of Artificial Sequence: Synthetic polypeptide
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 21 - protein, 345 aa, Sulfolobus islandicus
MEVPLYNIFGDNYIIQVATEAENSTIYNNKVEIDDEELRNVLNLAYKIAKNNEDAAAERRGKAKKKKGEEGETTTSNIILPLSGNDKNPWTETLKCYNFPTTVALSEVFKNFSQVKECEEVSAPSFVKPEFYEFGRSPGMVERTRRVKLEVEPHYLIIAAAGWVLTRLGKAKVSEGDYVGVNVFTPTRGILYSLIQNVNGIVPGIKPETAFGLWIARKVVSSVTNPNVSVVRIYTISDAVGQNPTTINGGFSIDLTKLLEKRYLLSERLEAIARNALSISSNMRERYIVLANYIYEYLTGSKRLEDLLYFANRDLIMNLNSDDGKVRDLKLISAYVNGELIRGEG

SEQ ID NO: 22 - protein, 345 aa, Sulfolobus islandicus
MEVPLYNIFGDNYIIQVATEAENSTIYNNKVEIDDEELRNVLNLAYKIAKNNEDAAAERRGKAKKKKGEEGETTTSNIILPLSGNDKNPWTETLKCYNFPTTVALSEVFKNFSQVKECEEVSAPSFVKPEFYKFGRSPGMVERTRRVKLEVEPHYLIMAAAGWVLTRLGKAKVSEGDYVGVNVFTPTRGILYSLIQNVNGIVPGIKPETAFGLWIARKVVSSVTNPNVSVVSIYTISDAVGQNPTTINGGFSIDLTKLLEKRDLLSERLEAIARNALSISSNMRERYIVLANYIYEYLTGSKRLEDLLYFANRDLIMNLNSDDGKVRDLKLISAYVNGELIRGEG

SEQ ID NO: 23 - protein, 1210 aa, Unknown
  Description of Unknown: uncultured Parcubacteria group bacterium sequence
MSKRHPRISGVKGYRLHAQRLEYTGKSGAMRTIKYPLYSSPSGGRTVPREIVSAINDDYVGLYGLSNFDDLYNAEKRNEEKVYSVLDFWYDCVQYGAVFSYTAPGLLKNVAEVRGGSYELTKTLKGSHLYDELQIDKVIKFLNKKEISRANGSLDKLKKDIIDCFKAEYRERHKDQCNKLADDIKNAKKDAGASLGERQKKLFRDFFGISEQSENDKPSFTNPLNLTCCLLPFDTVNNNRNRGEVLFNKLKEYAQKLDKNEGSLEMWEYIGIGNSGTAFSNFLGEGFLGRLRENKITELKKAMMDITDAWRGQEQEEELEKRLRILAALTIKLREPKFDNHWGGYRSDINGKLSSWLQNYINQTVKIKEDLKGHKKDLKKAKEMINRFGESDTKEEAVVSSLLESIEKIVPDDSADDEKPDIPAIAIYRRFLSDGRLTLNRFVQREDVQEALIKERLEAEKKKKPKKRKKKSDAEDEKETIDFKELFPHLAKPLKLVPNFYGDSKRELYKKYKNAAIYTDALWKAVEKIYKSAFSSSLKNSFFDTDFDKDFFIKRLQKIFSVYRRFNTDKWKPIVKNSFAPYCDIVSLAENEVLYKPKQSRSRKSAAIDKNRVRLPSTENIAKAGIALARELSVAGFDWKDLLKKEEHEEYIDLIELHKTALALLLAVTETQLDISALDFVENGTVKDFMKTRDGNLVLEGRFLEMFSQSIVFSELRGLAGLMSRKEFITRSAIQTMNGKQAELLYIPHEFQSAKITTPKEMSRAFLDLAPAEFATSLEPESLSEKSLLKLKQMRYYPHYFGYELTRTGQGIDGGVAENALRLEKSPVKKREIKCKQYKTLGRGQNKIVLYVRSSYYQTQFLEWFLHRPKNVQTDVAVSGSFLIDEKKVKTRWNYDALTVALEPVSGSERVFVSQPFTIFPEKSAEEEGQRYLGIDIGEYGIAYTALEITGDSAKILDQNFISDPQLKTLREEVKGLKLDQRRGTFAMPSTKIARIRESLVHSLRNRIHHLALKHKAKIVYELEVSRFEEGKQKIKKVYATLKKADVYSEIDADKNLQTTVWGKLAVASEISASYTSQFCGACKKLWRAEMQVDETITTQELIGTVRVIKGGTLIDAIKDFMRPPIFDENDTPFPKYRDFCDKHHISKKMRGNSCLFICPFCRANADADIQASQTIALLRYVKEEKKVEDYFERFRKLKNIKVLGQMKKI

SEQ ID NO: 24 - protein, 208 aa, Petromyzon marinus
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAV

SEQ ID NO: 25 - DNA, 766 bp, Petromyzon marinus
tgacacgacacagccgtgtatatgaggaagggtagctggatggggggggggggaatacgttcagagaggacattagcgagcgtcttgttggtggccttgagtctagacacctgcagacatgaccgacgctgagtacgtgagaatccatgagaagttggacatctacacgtttaagaaacagtttttcaacaacaaaaaatccgtgtcgcatagatgctacgttctctttgaattaaaacgacggggtgaacgtagagcgtgtttttggggctatgctgtgaataaaccacagagcgggacagaacgtggaattcacgccgaaatctttagcattagaaaagtcgaagaatacctgcgcgacaaccccggacaattcacgataaattggtactcatcctggagtccttgtgcagattgcgctgaaaagatcttagaatggtataaccaggagctgcgggggaacggccacactttgaaaatctgggcttgcaaactctattacgagaaaaatgcgaggaatcaaattgggctgtggaacctcagagataacggggttgggttgaatgtaatggtaagtgaacactaccaatgttgcaggaaaatattcatccaatcgtcgcacaatcaattgaatgagaatagatggcttgagaagactttgaagcgagctgaaaaacgacggagcgagttgtccattatgattcaggtaaaaatactccacaccactaagagtcctgctgtttaagaggctatgcggatggttttc

SEQ ID NO: 26 - protein, 145 aa, Homo sapiens
MDSLLMNRRKFLYQFKNVRWAKGRRETYLCYVVKRRDSATSFSLDFGYLRNKNGCHVELLFLRYISDWDLDPGRCYRVTWFTSWSPCYDCARHVADFLRGNPNLSLRIFTARLYFCEDRKAEPEGLRRLHRAGVQIAIMTFKAPV

SEQ ID NO: 27 - DNA, 10681 bp, Homo sapiens
agagaaccatcattaattgaagtgagatttttctggcctgagacttgcagggaggcaagaagacactctggacaccactatggacaggtaaagaggcagtcttctcgtgggtgattgcactggccttcctctcagagcaaatctgagtaatgagactggtagctatccctttctctcatgtaactgtctgactgataagatcagcttgatcaatatgcatatatattttttgatctgtctccttttcttctattcagatcttatacgctgtcagcccaattctttctgtttcagacttctcttgatttccctctttttcatgtggcaaaagaagtagtgcgtacaatgtactgattcgtcctgagatttgtaccatggttgaaactaatttatggtaataatattaacatagcaaatctttagagactcaaatcatgaaaaggtaatagcagtactgtactaaaaacggtagtgctaattttcgtaataattttgtaaatattcaacagtaaaacaacttgaagacacactttcctagggaggcgttactgaaataatttagctatagtaagaaaatttgtaattttagaaatgccaagcattctaaattaattgcttgaaagtcactatgattgtgtccattataaggagacaaattcattcaagcaagttatttaatgttaaaggcccaattgttaggcagttaatggcacttttactattaactaatctttccatttgttcagacgtagcttaacttacctcttaggtgtgaatttggttaaggtcctcataatgtctttatgtgcagtttttgataggttattgtcatagaacttattctattcctacatttatgattactatggatgtatgagaataacacctaatccttatactttacctcaatttaactcctttataaagaacttacattacagaataaagattttttaaaaatatatttttttgtagagacagggtcttagcccagccgaggctggtctctaagtcctggcccaagcgatcctcctgcctgggcctcctaaagtgctggaattatagacatgagccatcacatccaatatacagaataaagatttttaatggaggatttaatgttcttcagaaaattttcttgaggtcagacaatgtcaaatgtctcctcagtttacactgagattttgaaaacaagtctgagctataggtccttgtgaagggtccattggaaatacttgttcaaagtaaaatggaaagcaaaggtaaaatcagcagttgaaattcagagaaagacagaaaaggagaaaagatgaaattcaacaggacagaagggaaatatattatcattaaggaggacagtatctgtagagctcattagtgatggcaaaatgacttggtcaggattatttttaacccgcttgtttctggtttgcacggctggggatgcagctagggttctgcctcagggagcacagctgtccagagcagctgtcagcctgcaagcctgaaacactccctcggtaaagtccttcctactcaggacagaaatgacgagaacagggagctggaaacaggcccctaaccagagaagggaagtaatggatcaacaaagttaactagcaggtcaggatcacgcaattcatttcactctgactggtaacatgtgacagaaacagtgtaggcttattgtattttcatgtagagtaggacccaaaaatccacccaaagtcctttatctatgccacatccttcttatctatacttccaggacactttttcttccttatgataaggctctctctctctccacacacacacacacacacacacacacacacacacacacacacacaaacacacaccccgccaaccaaggtgcatgtaaaaagatgtagattcctctgcctttctcatctacacagcccaggagggtaagttaatataagagggatttattggtaagagatgatgcttaatctgtttaacactgggcctcaaagagagaatttcttttcttctgtacttattaagcacctattatgtgttgagcttatatatacaaagggttattatatgctaatatagtaatagtaatggtggttggtactatggtaattaccataaaaattattatccttttaaaataaagctaattattattggatcttttttagtattcattttatgttttttatgtttttgattttttaaaagacaatctcaccctgttacccaggctggagtgcagtggtgcaatcatagctttctgcagtcttgaactcctgggctcaagcaatcctcctgccttggcctcccaaagtgttgggatacagtcatgagccactgcatctggcctaggatccatttagattaaaatatgcattttaaattttaaaataatatggctaatttttaccttatgtaatgtgtatactggcaataaatctagtttgctgcctaaagtttaaagtgctttccagtaagcttcatgtacgtgaggggagacatttaaagtgaaacagacagccaggtgtggtggctcacgcctgtaatcccagcactctgggaggctgaggtgggtggatcgcttgagccctggagttcaagaccagcctgagcaacatggcaaaacgctgtttctataacaaaaattagccgggcatggtggcatgtgcctgtggtcccagctactagggggctgaggcaggagaatcgttggagcccaggaggtcaaggctgcactgagcagtgcttgcgccactgcactccagcctgggtgacaggaccagaccttgcctcaaaaaaataagaagaaaaattaaaaataaatggaaacaactacaaagagctgttgtcctagatgagctacttagttaggctgatattttggtatttaacttttaaagtcagggtctgtcacctgcactacattattaaaatatcaattctcaatgtatatccacacaaagactggtacgtgaatgttcatagtacctttattcacaaaaccccaaagtagagactatccaaatatccatcaacaagtgaacaaataaacaaaatgtgctatatccatgcaatggaataccaccctgcagtacaaagaagctacttggggatgaatcccaaagtcatgacgctaaatgaaagagtcagacatgaaggaggagataatgtatgccatacgaaattctagaaaatgaaagtaacttatagttacagaaagcaaatcagggcaggcatagaggctcacacctgtaatcccagcactttgagaggccacgtgggaagattgctagaactcaggagttcaagaccagcctgggcaacacagtgaaactccattctccacaaaaatgggaaaaaaagaaagcaaatcagtggttgtcctgtggggaggggaaggactgcaaagagggaagaagctctggtggggtgagggtggtgattcaggttctgtatcctgactgtggtagcagtttggggtgtttacatccaaaaatattcgtagaattatgcatcttaaatgggtggagtttactgtatgtaaattatacctcaatgtaagaaaaaataatgtgtaagaaaactttcaattctcttgccagcaaacgttattcaaattcctgagccctttacttcgcaaattctctgcacttctgccccgtaccattaggtgacagcactagctccacaaattggataaatgcatttctggaaaagactagggacaaaatccaggcatcacttgtgctttcatatcaaccatgctgtacagcttgtgttgctgtctgcagctgcaatggggactcttgatttctttaaggaaacttgggttaccagagtatttccacaaatgctattcaaattagtgcttatgatatgcaagacactgtgctaggagccagaaaacaaagaggaggagaaatcagtcattatgtgggaacaacatagcaagatatttagatcattttgactagttaaaaaagcagcagagtacaaaatcacacatgcaatcagtataatccaaatcatgtaaatatgtgcctgtagaaagactagaggaataaacacaagaatcttaacagtcattgtcattagacactaagtctaattattattattagacactatgatatttgagatttaaaaaatctttaatattttaaaatttagagctcttctatttttccatagtattcaagtttgacaatgatcaagtattactctttctttttttttttttttttttttttttgagatggagttttggtcttgttgcccatgctggagtggaatggcatgaccatagctcactgcaacctccacctcctgggttcaagcaaagctgtcgcctcagcctcccgggtagatgggattacaggcgcccaccaccacactcggctaatgtttgtatttttagtagagatggggtttcaccatgttggccaggctggtctcaaactcctgacctcagaggatccacctgcctcagcctcccaaagtgctgggattacagatgtaggccactgcgcccggccaagtattgctcttatacattaaaaaacaggtgtgagccactgcgcccagccaggtattgctcttatacattaaaaaataggccggtgcagtggctcacgcctgtaatcccagcactttgggaagccaaggcgggcagaacacccgaggtcaggagtccaaggccagcctggccaagatggtgaaaccccgtctctattaaaaatacaaacattacctgggcatgatggtgggcgcctgtaatcccagctactcaggaggctgaggcaggaggatccgcggagcctggcagatctgcctgagcctgggaggttgaggctacagtaagccaagatcatgccagtatacttcagcctgggcgacaaagtgagaccgtaacaaaaaaaaaaaaatttaaaaaaagaaatttagatcaagatccaactgtaaaaagtggcctaaacaccacattaaagagtttggagtttattctgcaggcagaagagaaccatcagggggtcttcagcatgggaatggcatggtgcacctggtttttgtgagatcatggtggtgacagtgtggggaatgttattttggagggactggaggcagacagaccggttaaaaggccagcacaacagataaggaggaagaagatgagggcttggaccgaagcagagaagagcaaacagggaaggtacaaattcaagaaatattggggggtttgaatcaacacatttagatgattaattaaatatgaggactgaggaataagaaatgagtcaaggatggttccaggctgctaggctgcttacctgaggtggcaaagtcgggaggagtggcagtttaggacagggggcagttgaggaatattgttttgatcattttgagtttgaggtacaagttggacacttaggtaaagactggaggggaaatctgaatatacaattatgggactgaggaacaagtttattttattttttgtttcgttttcttgttgaagaacaaatttaattgtaatcccaagtcatcagcatctagaagacagtggcaggaggtgactgtcttgtgggtaagggtttggggtccttgatgagtatctctcaattggccttaaatataagcaggaaaaggagtttatgatggattccaggctcagcagggctcaggagggctcaggcagccagcagaggaagtcagagcatcttctttggtttagcccaagtaatgacttccttaaaaagctgaaggaaaatccagagtgaccagattataaactgtactcttgcattttctctccctcctctcacccacagcctcttgatgaaccggaggaagtttctttaccaattcaaaaatgtccgctgggctaagggtcggcgtgagacctacctgtgctacgtagtgaagaggcgtgacagtgctacatccttttcactggactttggttatcttcgcaataaggtatcaattaaagtcggctttgcaagcagtttaatggtcaactgtgagtgcttttagagccacctgctgatggtattacttccatccttttttggcatttgtgtctctatcacattcctcaaatccttttttttatttctttttccatgtccatgcacccatattagacatggcccaaaatatgtgatttaattcctccccagtaatgctgggcaccctaataccactccttccttcagtgccaagaacaactgctcccaaactgtttaccagctttcctcagcatctgaattgcctttgagattaattaagctaaaagcatttttatatgggagaatattatcagcttgtccaagcaaaaattttaaatgtgaaaaacaaattgtgtcttaagcatttttgaaaattaaggaagaagaatttgggaaaaaattaacggtggctcaattctgtcttccaaatgatttcttttccctcctactcacatgggtcgtaggccagtgaatacattcaacatggtgatccccagaaaactcagagaagcctcggctgatgattaattaaattgatctttcggctacccgagagaattacatttccaagagacttcttcaccaaaatccagatgggtttacataaacttctgcccacgggtatctcctctctcctaacacgctgtgacgtctgggcttggtggaatctcagggaagcatccgtggggtggaaggtcatcgtctggctcgttgtttgatggttatattaccatgcaattttctttgcctacatttgtattgaatacatcccaatctccttcctattcggtgacatgacacattctatttcagaaggctttgattttatcaagcactttcatttacttctcatggcagtgcctattacttctcttacaatacccatctgtctgctttaccaaaatctatttccccttttcagatcctcccaaatggtcctcataaactgtcctgcctccacctagtggtccaggtatatttccacaatgttacatcaacaggcacttctagccattttccttctcaaaaggtgcaaaaagcaacttcataaacacaaattaaatcttcggtgaggtagtgtgatgctgcttcctcccaactcagcgcacttcgtcttcctcattccacaaaaacccatagccttccttcactctgcaggactagtgctgccaagggttcagctctacctactggtgtgctcttttgagcaagttgcttagcctctctgtaacacaaggacaatagctgcaagcatccccaaagatcattgcaggagacaatgactaaggctaccagagccgcaataaaagtcagtgaattttagcgtggtcctctctgtctctccagaacggctgccacgtggaattgctcttcctccgctacatctcggactgggacctagaccctggccgctgctaccgcgtcacctggttcacctcctggagcccctgctacgactgtgcccgacatgtggccgactttctgcgagggaaccccaacctcagtctgaggatcttcaccgcgcgcctctacttctgtgaggaccgcaaggctgagcccgaggggctgcggcggctgcaccgcgccggggtgcaaatagccatcatgaccttcaaaggtgcgaaagggccttccgcgcaggcgcagtgcagcagcccgcattcgggattgcgatgcggaatgaatgagttagtggggaagctcgaggggaagaagtgggcggggattctggttcacctctggagccgaaattaaagattagaagcagagaaaagagtgaatggctcagagacaaggccccgaggaaatgagaaaatggggccagggttgcttctttcccctcgatttggaacctgaactgtcttctacccccatatccccgcctttttttcctttttttttttttgaagattatttttactgctggaatacttttgtagaaaaccacgaaagaactttcaaagcctgggaagggctgcatgaaaattcagttcgtctctccagacagcttcggcgcatccttttggtaaggggcttcctcgctttttaaattttctttctttctctacagtcttttttggagtttcgtatatttcttatattttcttattgttcaatcactctcagttttcatctgatgaaaactttatttctcctccacatcagctttttcttctgctgtttcaccattcagagccctctgctaaggttccttttccctcccttttctttcttttgttgtttcacatctttaaatttctgtctctccccagggttgcgtttccttcctggtcagaattcttttctcctttttttttttttttttttttttttttaaacaaacaaacaaaaaacccaaaaaaactctttcccaatttactttcttccaacatgttacaaagccatccactcagtttagaagactctccggccccaccgacccccaacctcgttttgaagccattcactcaatttgcttctctctttctctacagcccctgtatgaggttgatgacttacgagacgcatttcgtactttgggactttgatagcaacttccaggaatgtcacacacgatgaaatatctctgctgaagacagtggataaaaaacagtccttcaagtcttctctgtttttattcttcaactctcactttcttagagtttacagaaaaaatatttatatacgactctttaaaaagatctatgtcttgaaaatagagaaggaacacaggtctggccagggacgtgctgcaattggtgcagttttgaatgcaacattgtcccctactgggaataacagaactgcaggacctgggagcatcctaaagtgtcaacgtttttctatgacttttaggtaggatgagagcagaaggtagatcctaaaaagcatggtgagaggatcaaatgtttttatatcaacatcctttattatttgattcatttgagttaacagtggtgttagtgatagatttttctattcttttcccttgacgtttactttcaagtaacacaaactcttccatcaggccatgatctataggacctcctaatgagagtatctgggtgattgtgaccccaaaccatctctccaaagcattaatatccaatcatgcgctgtatgttttaatcagcagaagcatgtttttatgtttgtacaaaagaagattgttatgggtggggatggaggtatagaccatgcatggtcaccttcaagctactttaataaaggatcttaaaatgggcaggaggactgtgaacaagacaccctaataatgggttgatgtctgaagtagcaaatcttctggaaacgcaaactcttttaaggaagtccctaatttagaaacacccacaaacttcacatatcataattagcaaacaattggaaggaagttgcttgaatgttggggagaggaaaatctattggctctcgtgggtctcttcatctcagaaatgccaatcaggtcaaggtttgctacattttgtatgtgtgtgatgcttctcccaaaggtatattaactatataagagagttgtgacaaaacagaatgataaagctgcgaaccgtggcacacgctcatagttctagctgcttgggaggttgaggagggaggatggcttgaacacaggtgttcaaggccagcctgggcaacataacaagatcctgtctctcaaaaaaaaaaaaaaaaaaaagaaagagagagggccgggcgtggtggctcacgcctgtaatcccagcactttgggaggccgagccgggcggatcacctgtggtcaggagtttgagaccagcctggccaacatggcaaaaccccgtctgtactcaaaatgcaaaaattagccaggcgtggtagcaggcacctgtaatcccagctacttgggaggctgaggcaggagaatcgcttgaacccaggaggtggaggttgcagtaagctgagatcgtgccgttgcactccagcctgggcgacaagagcaagactctgtctcagaaaaaaaaaaaaaaaagagagagagagagaaagagaacaatatttgggagagaaggatggggaagcattgcaaggaaattgtgctttatccaacaaaatgtaaggagccaataagggatccctatttgtctcttttggtgtctatttgtccctaacaactgtctttgacagtgagaaaaatattcagaataaccatatccctgtgccgttattacctagcaacccttgcaatgaagatgagcagatccacaggaaaacttgaatgcacaactgtcttattttaatcttattgtacataagtttgtaaaagagttaaaaattgttacttcatgtattcatttatattttatattattttgcgtctaatgattttttattaacatgatttccttttctgatatattgaaatggagtctcaaagcttcataaatttataactttagaaatgattctaataacaacgtatgtaattgtaacattgcagtaatggtgctacgaagccatttctcttgatttttagtaaacttttatgacagcaaatttgcttctggctcactttcaatcagttaaataaatgataaataattttggaagctgtgaagataaaataccaaataaaataatataaaagtgatttatatgaagttaaaataaaaaatcagtatgatggaataaacttg

SEQ ID NO: 28 - protein, 198 aa, Homo sapiens [sequence omitted]

SEQ ID NO: 29 - protein, 198 aa, Mus musculus
MDSLLMKQKKFLYHFKNVRWAKGRHETYLCYVVKRRDSATSCSLDFGHLRNKSGCHVELLFLRYISDWDLDPGRCYRVTWFTSWSPCYDCARHVAEFLRWNPNLSLRIFTARLYFCEDRKAEPEGLRRLHRAGVQIGIMTFKDYFYCWNTFVENRERTFKAWEGLHENSVRLTRQLRRILLPLYEVDDLRDAFRMLGF

SEQ ID NO: 30 - protein, 198 aa, Canis lupus
MDSLLMKQRKFLYHFKNVRWAKGRHETYLCYVVKRRDSATSFSLDFGHLRNKSGCHVELLFLRYISDWDLDPGRCYRVTWFTSWSPCYDCARHVADFLRGYPNLSLRIFAARLYFCEDRKAEPEGLRRLHRAGVQIAIMTFKDYFYCWNTFVENREKTFKAWEGLHENSVRLSRQLRRILLPLYEVDDLRDAFRTLGL

SEQ ID NO: 31 - protein, 199 aa, Bos sp.
MDSLLKKQRQFLYQFKNVRWAKGRHETYLCYVVKRRDSPTSFSLDFGHLRNKAGCHVELLFLRYISDWDLDPGRCYRVTWFTSWSPCYDCARHVADFLRGYPNLSLRIFTARLYFCDKERKAEPEGLRRLHRAGVQIAIMTFKDYFYCWNTFVENHERTFKAWEGLHENSVRLSRQLRRILLPLYEVDDLRDAFRTLGL

SEQ ID NO: 32 - protein, 239 aa, Rattus norvegicus
MAVGSKPKAALVGPHWERERIWCFLCSTGLGTQQTGQTSRWLRPAATQDPVSPPRSLLMKQRKFLYHFKNVRWAKGRHETYLCYVVKRRDSATSFSLDFGYLRNKSGCHVELLFLRYISDWDLDPGRCYRVTWFTSWSPCYDCARHVADFLRGNPNLSLRIFTARLTGWGALPAGLMSPARPSDYFYCWNTFVENHERTFKAWEGLHENSVRLSRRLRRILLPLYEVDDLRDAFRTLGL

SEQ ID NO: 33 - protein, 429 aa, Mus musculus
MGPFCLGCSHRKCYSPIRNLISQETFKFHFKNLGYAKGRKDTFLCYEVTRKDCDSPVSLHHGVFKNKDNIHAEICFLYWFHDKVLKVLSPREEFKITWYMSWSPCFECAEQIVRFLATHHNLSLDIFSSRLYNVQDPETQQNLCRLVQEGAQVAAMDLYEFKKCWKKFVDNGGRRFRPWKRLLTNFRYQDSKLQEILRPCYIPVPSSSSSTLSNICLTKGLPETRFCVEGRRMDPLSEEEFYSQFYNQRVKHLCYYHRMKPYLCYQLEQFNGQAPLKGCLLSEKGKQHAEILFLDKIRSMELSQVTITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLRRIKESWGLQDLVNDFGNLQLGPPMS

SEQ ID NO: 34 - protein, 430 aa, Rattus norvegicus
MGPFCLGCSHRKCYSPIRNLISQETFKFHFKNRLRYAIDRKDTFLCYEVTRKDCDSPVSLHHGVFKNKDNIHAEICFLYWFHDKVLKVLSPREEFKITWYMSWSPCFECAEQVLRFLATHHNLSLDIFSSRLYNIRDPENQQNLCRLVQEGAQVAAMDLYEFKKCWKKFVDNGGRRFRPWKKLLTNFRYQDSKLQEILRPCYIPVPSSSSSTLSNICLTKGLPETRFCVERRRVHLLSEEEFYSQFYNQRVKHLCYYHGVKPYLCYQLEQFNGQAPLKGCLLSEKGKQHAEILFLDKIRSMELSQVIITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLHRIKESWGLQDLVNDFGNLQLGPPMS

SEQ ID NO: 35 - protein, 370 aa, Macaca mulatta
MVEPMDPRTFVSNFNNRPILSGLNTVWLCCEVKTKDPSGPPLDAKIFQGKVYSKAKYHPEMRFLRWFHKWRQLHHDQEYKVTWYVSWSPCTRCANSVATFLAKDPKVTLTIFVARLYYFWKPDYQQALRILCQKRGGPHATMKIMNYNEFQDCWNKFVDGRGKPFKPRNNLPKHYTLLQATLGELLRHLMDPGTFTSNFNNKPWVSGQHETYLCYKVERLHNDTWVPLNQHRGFLRNQAPNIHGFPKGRHAELCFLDLIPFWKLDGQQYRVTCFTSWSPCFSCAQEMAKFISNNEHVSLCIFAARIYDDQGRYQEGLRALHRDGAKIAMMNYSEFEYCWDTFVDRQGRPFQPWDGLDEHSQALSGRLRAI

SEQ ID NO: 36 - protein, 384 aa, Pan sp.
MKPHFRNPVERMYQDTFSDNFYNRPILSHRNTVWLCYEVKTKGPSRPPLDAKIFRGQVYSKLKYHPEMRFFHWFSKWRKLHRDQEYEVTWYISWSPCTKCTRDVATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTSNFNNELWVRGRHETYLCYEVERLHNDTWVLLNQRRGFLCNQAPHKHGFLEGRHAELCFLDVIPFWKLDLHQDYRVTCFTSWSPCFSCAQEMAKFISNNKHVSLCIFAARIYDDQGRCQEGLRTLAKAGAKISIMTYSEFKHCWDTFVDHQGCPFQPWDGLEEHSQALSGRLRAILQNQGN

SEQ ID NO: 37 - protein, 377 aa, Chlorocebus sabaeus
MNPQIRNMVEQMEPDIFVYYFNNRPILSGRNTVWLCYEVKTKDPSGPPLDANIFQGKLYPEAKDHPEMKFLHWFRKWRQLHRDQEYEVTWYVSWSPCTRCANSVATFLAEDPKVTLTIFVARLYYFWKPDYQQALRILCQERGGPHATMKIMNYNEFQHCWNEFVDGQGKPFKPRKNLPKHYTLLHATLGELLRHVMDPGTFTSNFNNKPWVSGQRETYLCYKVERSHNDTWVLLNQHRGFLRNQAPDRHGFPKGRHAELCFLDLIPFWKLDDQQYRVTCFTSWSPCFSCAQKMAKFISNNKHVSLCIFAARIYDDQGRCQEGLRTLHRDGAKIAVMNYSEFEYCWDTFVDRQGRPFQPWDGLDEHSQALSGRLRAI

SEQ ID NO: 38 - protein, 384 aa, Homo sapiens
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQNQEN

SEQ ID NO: 39 - protein, 373 aa, Homo sapiens
MKPHFRNTVERMYRDTFSYNFYNRPILSRRNTVWLCYEVKTKGPSRPRLDAKIFRGQVYSQPEHHAEMCFLSWFCGNQLPAYKCFQITWFVSWTPCPDCVAKLAEFLAEHPNVTLTISAARLYYYWERDYRRALCRLSQAGARVKIMDDEEFAYCWENFVYSEGQPFMPWYKFDDNYAFLHRTLKEILRNPMEAMYPHIFYFHFKNLRKAYGRNESWLCFTMEVVKHHSPVSWKRGVFRNQVDPETHCHAERCFLSWFCDDILSPNTNYEVTWYTSWSPCPECAGEVAEFLARHSNVNLTIFTARLYYFWDTDYQEGLRSLSQEGASVEIMGYKDFKYCWENFVYNDDEPFKPWKGLKYNFLFLDSKLQEILE

SEQ ID NO: 40 - protein, 382 aa, Homo sapiens
MNPQIRNPMERMYRDTFYDNFENEPILYGRSYTWLCYEVKIKRGRSNLLWDTGVFRGQVYFKPQYHAEMCFLSWFCGNQLPAYKCFQITWFVSWTPCPDCVAKLAEFLSEHPNVTLTISAARLYYYWERDYRRALCRLSQAGARVTIMDYEEFAYCWENFVYNEGQQFMPWYKFDENYAFLHRTLKEILRYLMDPDTFTFNFNNDPLVLRRRQTYLCYEVERLDNGTWVLMDQHMGFLCNEAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFEYCWDTFVYRQGCPFQPWDGLEEHSQALSGRLRAILQNQGN

SEQ ID NO: 41 - protein, 395 aa, Rattus norvegicus
MQPQGLGPNAGMGPVCLGCSHRRPYSPIRNPLKKLYQQTFYFHFKNVRYAWGRKNNFLCYEVNGMDCALPVPLRQGVFRKQGHIHAELCFIYWFHDKVLRVLSPMEEFKVTWYMSWSPCSKCAEQVARFLAAHRNLSLAIFSSRLYYYLRNPNYQQKLCRLIQEGVHVAAMDLPEFKKCWNKFVDNDGQPFRPWMRLRINFSFYDCKLQEIFSRMNLLREDVFYLQFNNSHRVKPVQNRYYRRKSYLCYQLERANGQEPLKGYLLYKKGEQHVEILFLEKMRSMELSQVRITCYLTWSPCPNCARQLAAFKKDHPDLILRIYTSRLYFWRKKFQKGLCTLWRSGIHVDVMDLPQFADCWTNFVNPQRPFRPWNELEKNSWRIQRRLRRIKESWGL

SEQ ID NO: 42 - protein, 226 aa, Bos sp.
DGWEVAFRSGTVLKAGVLGVSMTEGWAGSGHPGQGACVWTPGTRNTMNLLREVLFKQQFGNQPRVPAPYYRRKTYLCYQLKQRNDLTLDRGCFRNKKQRHAERFIDKINSLDLNPSQSYKIICYITWSPCPNCANELVNFITRNNHLKLEIFASRLYFHWIKSFKMGLQDLQNAGISVAVMTHTEFEDCWEQFVDNQSRPFQPWDKLEQYSASIRRRLQRILTAPI

SEQ ID NO: 43 - protein, 490 aa, Pan sp.
MNPQIRNPMEWMYQRTFYYNFENEPILYGRSYTWLCYEVKIRRGHSNLLWDTGVFRGQMYSQPEHHAEMCFLSWFCGNQLSAYKCFQITWFVSWTPCPDCVAKLAKFLAEHPNVTLTISAARLYYYWERDYRRALCRLSQAGARVKIMDDEEFAYCWENFVYNEGQPFMPWYKFDDNYAFLHRTLKEIIRHLMDPDTFTFNFNNDPLVLRRHQTYLCYEVERLDNGTWVLMDQHMGFLCNEAKNLLCGFYGRHAELRFLDLVPSLQLDPAQIYRVTWFISWSPCFSWGCAGQVRAFLQENTHVRLRIFAARIYDYDPLYKEALQMLRDAGAQVSIMTYDEFEYCWDTFVYRQGCPFQPWDGLEEHSQALSGRLRAILQVRASSLCMVPHRPPPPPQSPGPCLPLCSEPPLGSLLPTGRPAPSLPFLLTASFSFPPPASLPPLPSLSLSPGHLPVPSFHSLTSCSIQPPCSSRIRETEGWASVSKEGRDLG

SEQ ID NO: 44 - protein, 190 aa, Homo sapiens
MNPQIRNPMKAMYPGTFYFQFKNLWEANDRNETWLCFTVEGIKRRSVVSWKTGVFRNQVDSETHCHAERCFLSWFCDDILSPNTKYQVTWYTSWSPCPDCAGEVAEFLARHSNVNLTIFTARLYYFQYPCYQEGLRSLSQEGVAVEIMDYEDFKYCWENFVYNDNEPFKPWKGLKTNFRLLKRRLRESLQ

SEQ ID NO: 45 - protein, 190 aa, Gorilla sp.
MNPQIRNPMKAMYPGTFYFQFKNLWEANDRNETWLCFTVEGIKRRSVVSWKTGVFRNQVDSETHCHAERCFLSWECDDILSPNTNYQVTWYTSWSPCPECAGEVAEFLARHSNVNLTIFTARLYYFQDTDYQEGLRSLSQEGVAVKIMDYKDFKYCWENFVYNDDEPFKPWKGLKYNFRFLKRRLQEILE

SEQ ID NO: 46 - protein, 199 aa, Homo sapiens
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGN

SEQ ID NO: 47 - protein, 202 aa, Macaca mulatta
MDGSPASRPRHLMDPNTFTFNFNNDLSVRGRHQTYLCYEVERLDNGTWVPMDERRGFLCNKAKNVPCGDYGCHVELRFLCEVPSWQLDPAQTYRVTWFISWSPCFRRGCAGQVRVFLQENKHVRLRIFAARIYDYDPLYQEALRTLRDAGAQVSIMTYEEFKHCWDTFVDRQGRPFQPWDGLDEHSQALSGRLRAILQNQGN

SEQ ID NO: 48 - protein, 185 aa, Bos sp.
MDEYTFTENFNNQGWPSKTYLCYEMERLDGDATIPLDEYKGFVRNKGLDQPEKPCHAELYFLGKIHSWNLDRNQHYRLTCFISWSPCYDCAQKLTTFLKENHHISLHILASRIYTHNRFGCHQSGLCELQAAGARITIMTFEDFKHCWETFVDHKGKPFQPWEGLNVKSQALCTELQAILKTQQN

SEQ ID NO: 49 - protein, 200 aa, Homo sapiens
MALLTAETFRLQFNNKRRLRRPYYPRKALLCYQLTPQNGSTPTRGYFENKKKCHAEICFINEIKSMGLDETQCYQVTCYLTWSPCSSCAWELVDFIKAHDHLNLGIFASRLYYHWCKPQQKGLRLLCGSQVPVEVMGFPKFADCWENFVDHEKPLSFNPYKMLEELDKNSRAIKRRLERIKIPGVRAQGRYMDILCDAEV

SEQ ID NO: 50 - protein, 210 aa, Macaca mulatta
MALLTAKTFSLQFNNKRRVNKPYYPRKALLCYQLTPQNGSTPTRGHLKNKKKDHAEIRFINKIKSMGLDETQCYQVTCYLTWSPCPSCAGELVDFIKAHRHLNLRIFASRLYYHWRPNYQEGLLLLCGSQVPVEVMGLPEFTDCWENFVDHKEPPSFNPSEKLEELDKNSQAIKRRLERIKSRSVDVLENGLRSLQLGPVTPSSSIRNSR

SEQ ID NO: 51 - protein, 386 aa, Homo sapiens
MNPQIRNPMERMYRDTFYDNFENEPILYGRSYTWLCYEVKIKRGRSNLLWDTGVFRGPVLPKRQSNHRQEVYFRFENHAEMCFLSWFCGNRLPANRRFQITWFVSWNPCLPCVVKVTKFLAEHPNVTLTISAARLYYYRDRDWRWVLLRLHKAGARVKIMDYEDFAYCWENFVCNEGQPFMPWYKFDDNYASLHRTLKEILRNPMEAMYPHIFYFHFKNLLKACGRNESWLCFTMEVTKHHSAVFRKRGVFRNQVDPETHCHAERCFLSWFCDDILSPNTNYEVTWYTSWSPCPECAGEVAEFLARHSNVNLTIFTARLCYFWDTDYQEGLCSLSQEGASVKIMGYKDFVSCWKNFVYSDDEPFKPWKGLQTNFRLLKRRLREILQ

SEQ ID NO: 52 - protein, 236 aa, Homo sapiens
MTSEKGPSTGDPTLRRRIEPWEFDVFYDPRELRKEACLLYEIKWGMSRKIWRSSGKNTTNHVEVNFIKKFTSERDFHPSMSCSITWFLSWSPCWECSQAIREFLSRHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFRLHLQNCHYQTIPPHILLATGLIHPSVAWR

SEQ ID NO: 53 - protein, 229 aa, Mus musculus
MSSETGPVAVDPTLRRRIEPHEFEVFFDPRELRKETCLLYEINWGGRHSVWRHTSQNTSNHVEVNFLEKFTTERYFRPNTRCSITWFLSWSPCGECSRAITEFLSRHPYVTLFIYIARLYHHTDQRNRQGLRDLISSGVTIQIMTEQEYCYCWRNFVNYPPSNEAYWPRYPHLWVKLYVLELYCIILGLPPCLKILRRKQPQLTFFTITLQTCHYQRIPPHLLWATGLK

SEQ ID NO: 54 - protein, 229 aa, Rattus norvegicus [sequence omitted]

SEQ ID NO: 55 - protein, 224 aa, Homo sapiens
MAQKEEAAVATEAASQNGEDLENLDDPEKLKELIELPPFEIVTGERLPANFFKFQFRNVEYSSGRNKTFLCYVVEAQGKGGQVQASRGYLEDEHAAAHAEEAFFNTILPAFDPALRYNVTWYVSSSPCAACADRIIKTLSKTKNLRLLILVGRLFMWEEPEIQAALKKLKEAGCKLRIMKPQDFEYVWQNFVEQEEGESKAFQPWEDIQENFLYYEEKLADILK

SEQ ID NO: 56 - protein, 224 aa, Mus musculus
MAQKEEAAEAAAPASQNGDDLENLEDPEKLKELIDLPPFEIVTGVRLPVNFFKFQFRNVEYSSGRNKTFLCYVVEVQSKGGQAQATQGYLEDEHAGAHAEEAFFNTILPAFDPALKYNVTWYVSSSPCAACADRILKTLSKTKNLRLLILVSRLFMWEEPEVQAALKKLKEAGCKLRIMKPQDFEYIWQNFVEQEEGESKAFEPWEDIQENFLYYEEKLADILK

SEQ ID NO: 57 - protein, 224 aa, Rattus norvegicus
MAQKEEAAEAAAPASQNGDDLENLEDPEKLKELIDLPPFEIVTGVRLPVNFFKFQFRNVEYSSGRNKTFLCYVVEAQSKGGQVQATQGYLEDEHAGAHAEEAFFNTILPAFDPALKYNVTWYVSSSPCAACADRILKTLSKTKNLRLLILVSRLFMWEEPEVQAALKKLKEAGCKLRIMKPQDFEYLWQNFVEQEEGESKAFEPWEDIQENFLYYEEKLADILK

SEQ ID NO: 58 - protein, 224 aa, Bos sp.
MAQKEEAAAAAEPASQNGEEVENLEDPEKLKELIELPPFEIVTGERLPAHYFKFQFRNVEYSSGRNKTFLCYVVEAQSKGGQVQASRGYLEDEHATNHAEEAFFNSIMPTFDPALRYMVTWYVSSSPCAACADRIVKTLNKTKNLRLLILVGRLFMWEEPEIQAALRKLKEAGCRLRIMKPQDFEYIWQNFVEQEEGESKAFEPWEDIQENFLYYEEKLADILK

SEQ ID NO: 59 - protein, 208 aa, Petromyzon marinus
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSFMIQVKILHTTKSPAV

SEQ ID NO: 60 - protein, 381 aa, Homo sapiens
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKFNYDEFQHCWSKFVYSQRELFEPWNNLPKYYILLHFMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKKHVSLCIFTARIYRRQGRCQEGLRTLAEAGAKISFTYSEFKHCWDTFVDHQGCPFQPWDGLDEHSQDLSGRLRAILQNQEN

SEQ ID NO: 61 - protein, 182 aa, Homo sapiens
MDPPTFTFNFNNEPWWGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISFTYSEFKHCWDTFVDHQGCPFQPWDGLDEHSQDLSGRLRAILQ

SEQ ID NO: 62 - protein, 184 aa, Homo sapiens
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYRRQGRCQEGLRTLAEAGAKISFMTYSEFKHCWDTFVDHQGCPFQPWDGLDEHSQDLSGRLRAILQ

SEQ ID NO: 63 - DNA, 306 bp, Artificial Sequence
  Description of Artificial Sequence: Synthetic polynucleotide
tgcctgtcatacgaaaccgagatactgacagtagaatatggccttctgccaatcgggaagattgtggagaaacggatagaatgcacagtttactctgtcgataacaatggtaacatttatactcagccagttgcccagtggcacgaccggggagagcaggaagtattcgaatactgtctggaggatggaagtctcattagggccactaaggaccacaaatttatgacagtcgatggccagatgctgcctatagacgaaatctttgagcgagagttggacctcatgcgagttgacaaccttcctaat

SEQ ID NO: 64 - protein, 102 aa, Artificial Sequence
  Description of Artificial Sequence: Synthetic polypeptide
CLSYETEILTVEYGLLPIGKIVEKRIECTVYSVDNNGNIYTQPVAQWHDRGEQEVFEYCLEDGSLIRATKDHKFMTVDGQMLPIDEIFERELDLMRVDNLPN

SEQ ID NO: 65 - DNA, 108 bp, Artificial Sequence
  Description of Artificial Sequence: Synthetic polynucleotide
atgatcaagatagctacaaggaagtatcttggcaaacaaaacgtttatgatattggagtcgaaagagatcacaactttgctctgaagaacggattcatagcttctaat

SEQ ID NO: 66 - protein, 36 aa, Artificial Sequence
  Description of Artificial Sequence: Synthetic polypeptide
MIKIATRKYLGKQNVYDIGVERDHNFALKNGFIASN

SEQ ID NO: 67 - DNA, 303 bp, Artificial Sequence
  Description of Artificial Sequence: Synthetic polynucleotide
tgcctgtcttatgataccgagatacttaccgttgaatatggcttcttgcctattggaaagattgtcgaagagagaattgaatgcacagtatatactgtagacaagaatggtttcgtttacacacagcccattgctcaatggcacaatcgcggcgaacaagaagtatttgagtactgtctcgaggatggaagcatcatacgagcaactaaagatcataaattcatgaccactgacgggcagatgttgccaatagatgagatattcgagcggggcttggatctcaaacaagtggatggattgcca

SEQ ID NO: 68 - protein, 101 aa, Artificial Sequence
  Description of Artificial Sequence: Synthetic polypeptide
CLSYDTEILTVEYGFLPIGKIVEERIECTVYTVDKNGFVYTQPIAQWHNRGEQEVFEYCLEDGSIIRATKDHKFMTTDGQMLPIDEIFERGLDLKQVDGLP

SEQ ID NO: 69 - DNA, 159 bp, Artificial Sequence
  Description of Artificial Sequence: Synthetic polynucleotide
atgaagaggactgccgatggatcagagtttgaatctcccaagaagaagaggaaagtaaagataatatctcgaaaaagtcttggtacccaaaatgtctatgatattggagtggagaaagatcacaacttccttctcaagaacggtctcgtagccagcaac

SEQ ID NO: 70 - protein, 53 aa, Artificial Sequence
  Description of Artificial Sequence: Synthetic polypeptide
MKRTADGSEFESPKKKRKVKIISRKSLGTQNVYDIGVEKDHNFLLKNGLVASN

SEQ ID NO: 71 - protein, 16 aa, Artificial Sequence
  Description of Artificial Sequence: Synthetic peptide
SGSETPGTSESATPES

SEQ ID NO: 72 - protein, 120 aa, Artificial Sequence
  Description of Artificial Sequence: Synthetic polypeptide
  MISC_FEATURE (1)..(120): This sequence may encompass 1-30 "Ser Gly Gly Ser" repeating units
SGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGS

SEQ ID NO: 73 - protein, 120 aa, Artificial Sequence
  Description of Artificial Sequence: Synthetic polypeptide
  MISC_FEATURE (1)..(120): This sequence may encompass 1-30 "Gly Gly Gly Ser" repeating units
GGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGS

SEQ ID NO: 74 - protein, 150 aa, Artificial Sequence
  Description of Artificial Sequence: Synthetic polypeptide
  MISC_FEATURE (1)..(150): This sequence may encompass 1-30 "Gly Gly Gly Gly Ser" repeating units
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 75 - protein, 30 aa, Artificial Sequence
  Description of Artificial Sequence: Synthetic polypeptide
  MISC_FEATURE (1)..(30): This sequence may encompass 1-30 residues
GGGGGGGGGGGGGGGGGGGGGGGGGGGGGG

SEQ ID NO: 76 - protein, 150 aa, Artificial Sequence
  Description of Artificial Sequence: Synthetic polypeptide
  MISC_FEATURE (1)..(150): This sequence may encompass 1-30 "Glu Ala Ala Ala Lys" repeating units
EAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAK

SEQ ID NO: 77 - protein, 90 aa, Artificial Sequence
  Description of Artificial Sequence: Synthetic polypeptide
  MISC_FEATURE (1)..(90): This sequence may encompass 1-30 "Gly Gly Ser" repeating units
GGSGGSGGSGGSGGSGGSGGSGGSGGSGGSGGSGGSGGSGGSGGSGGSGGSGGSGGSGGSGGSGGSGGSGGSGGSGGSGGSGGSGGSGGS

SEQ ID NO: 78 - protein, 4 aa, Artificial Sequence
  Description of Artificial Sequence: Synthetic peptide
SGGS

SEQ ID NO: 79 - protein, 60 aa, Artificial Sequence
  Description of Artificial Sequence: Synthetic polypeptide
  MOD_RES (1)..(1): Any amino acid
  MOD_RES (3)..(3): Any amino acid
  MOD_RES (5)..(5): Any amino acid
  MOD_RES (7)..(7): Any amino acid
  MOD_RES (9)..(9): Any amino acid
  MOD_RES (11)..(11): Any amino acid
  MOD_RES (13)..(13): Any amino acid
  MOD_RES (15)..(15): Any amino acid
  MOD_RES (17)..(17): Any amino acid
  MOD_RES (19)..(19): Any amino acid
  MOD_RES (21)..(21): Any amino acid
  MOD_RES (23)..(23): Any amino acid
  MOD_RES (25)..(25): Any amino acid
  MOD_RES (27)..(27): Any amino acid
  MOD_RES (29)..(29): Any amino acid
  MOD_RES (31)..(31): Any amino acid
  MOD_RES (33)..(33): Any amino acid
  MOD_RES (35)..(35): Any amino acid
  MOD_RES (37)..(37): Any amino acid
  MOD_RES (39)..(39): Any amino acid
  MOD_RES (41)..(41): Any amino acid
  MOD_RES (43)..(43): Any amino acid
  MOD_RES (45)..(45): Any amino acid
  MOD_RES (47)..(47): Any amino acid
  MOD_RES (49)..(49): Any amino acid
  MOD_RES (51)..(51): Any amino acid
  MOD_RES (53)..(53): Any amino acid
  MOD_RES (55)..(55): Any amino acid
  MOD_RES (57)..(57): Any amino acid
  MOD_RES (59)..(59): Any amino acid
  MISC_FEATURE (1)..(60): This sequence may encompass 1-30 "Xaa Pro" repeating units, wherein Xaa is any amino acid
XPXPXPXPXPXPXPXPXPXPXPXPXPXPXPXPXPXPXPXPXPXPXPXPXPXPXPXPXPXP

SEQ ID NO: 80 - protein, 24 aa, Artificial Sequence
  Description of Artificial Sequence: Synthetic peptide
SGGSSGSETPGTSESATPESSGGS

SEQ ID NO: 81 - protein, 32 aa, Artificial Sequence
  Description of Artificial Sequence: Synthetic polypeptide
SGGSSGGSSGSETPGTSESATPESSGGSSGGS

SEQ ID NO: 82 - protein, 104 aa, Artificial Sequence
  Description of Artificial Sequence: Synthetic polypeptide
GGSGGSPGSPAGSPTSTEEGTSESATPESGPGTSTEPSEGSAPGSPAGSPTSTEEGTSTEPSEGSAPGTSTEPSEGSAPGTSESATPESGPGSEPATSGGSGGS

SEQ ID NO: 83 - protein, 24 aa, Artificial Sequence
  Description of Artificial Sequence: Synthetic peptide
SGGSSGGSSGSETPGTSESATPES

SEQ ID NO: 84 - protein, 40 aa, Artificial Sequence
  Description of Artificial Sequence: Synthetic polypeptide
SGGSSGGSSGSETPGTSESATPESSGGSSGGSSGGSSGGS

SEQ ID NO: 85 - protein, 64 aa, Artificial Sequence
  Description of Artificial Sequence: Synthetic polypeptide
SGGSSGGSSGSETPGTSESATPESSGGSSGGSSGGSSGGSSGSETPGTSESATPESSGGSSGGS

SEQ ID NO: 86 - protein, 92 aa, Artificial Sequence
  Description of Artificial Sequence: Synthetic polypeptide
PGSPAGSPTSTEEGTSESATPESGPGTSTEPSEGSAPGSPAGSPTSTEEGTSTEPSEGSAPGTSTEPSEGSAPGTSESATPESGPGSEPATS

SEQ ID NO: 87 - protein, 18 aa, Artificial Sequence
  Description of Artificial Sequence: Synthetic peptide
KRTADGSEFESPKKKRKV

SEQ ID NO: 88 - protein, 16 aa, Artificial Sequence
  Description of Artificial Sequence: Synthetic peptide
KRPAATKKAGQAKKKK

SEQ ID NO: 89 - protein, 17 aa, Artificial Sequence
  Description of Artificial Sequence: Synthetic peptide
KKTELQTTNAENKTKKL

SEQ ID NO: 90 - protein, 19 aa, Artificial Sequence
  Description of Artificial Sequence: Synthetic peptide
KRGINDRNFWRGENGRKTR

SEQ ID NO: 91 - protein, 16 aa, Artificial Sequence
  Description of Artificial Sequence: Synthetic peptide
RKSGKIAAIVVKRPRK

SEQ ID NO: 92 - protein, 7 aa, Artificial Sequence
  Description of Artificial Sequence: Synthetic peptide
PKKKRKV

SEQ ID NO: 93 - protein, 30 aa, Artificial Sequence
  Description of Artificial Sequence: Synthetic polypeptide
MDSLLMNRRKFLYQFKNVRWAKGRRETYLC

SEQ ID NO: 94 - protein, 84 aa, Bacillus phage PBS2
MTNLSDIIEKETGKQLVIQESILMLPEEVEEVIGNKPESDILVHTAYDESTDENVMLLTSDAPEYKPWALVIQDSNGENKIKML

SEQ ID NO: 95 - protein, 166 aa, Artificial Sequence
  Description of Artificial Sequence: Synthetic polypeptide
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 96 - protein, 166 aa, Artificial Sequence
  Description of Artificial Sequence: Synthetic polypeptide
SEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTD

SEQ ID NO: 97 - protein, 1052 aa, Artificial Sequence
  Description of Artificial Sequence: Synthetic polypeptide
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 98 - protein, 1052 aa, Artificial Sequence
  Description of Artificial Sequence: Synthetic polypeptide
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 99 - protein, 1052 aa, Artificial Sequence
  Description of Artificial Sequence: Synthetic polypeptide
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKG

SEQ ID NO: 100 - protein, 1367 aa, Artificial Sequence
  Description of Artificial Sequence: Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFESPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 101 - protein, 1367 aa, Artificial Sequence
  Description of Artificial Sequence: Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 102 - protein, 1367 aa, Artificial Sequence
  Description of Artificial Sequence: Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 103 - protein, 1367 aa, Artificial Sequence
  Description of Artificial Sequence: Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTAFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGALSRKLINGIRDKQSGKTILDFLKSDGFANRNFMALIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRAITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 104 - protein, 1368 aa, Artificial Sequence [sequence omitted]

SEQ ID NO: 105 - protein, 1367 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFESPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 106 - protein, 1368 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 107 - protein, 1368 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 108 - protein, 1359 aa, Artificial Sequence
  Description of Artificial Sequence: Synthetic polypeptide
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEIQTVGQNGGLFDDNPKSPLEVTPSKLVPLKKELNPKKYGGYQKPTTAYPVLLITDTKQLIPISVMNKKQFEQNPVKFLRDRGYQQVGKNDFIKLPKYTLVDIGDGIKRLWASSKEIHKGNQLVVSKKSQILLYHAHHLDSDLSNDYLQNHNQQFDVLFNEIISFSKKCKLGKEHIQKIENVYSNKKNSASIEELAESFIKLLGFTQLGATSPFNFLGVKLNQKQYKGKKDYILPCTEGTLIRQSITGLYETRVDLSKIGED

SEQ ID NO: 109 - protein, 29 aa, Artificial Sequence
  Description of Artificial Sequence: Synthetic peptide
PKKKRKVEGADKRTADGSEFESPKKKRKV

SEQ ID NO: 110 - protein, 23 aa, Artificial Sequence
  Description of Artificial Sequence: Synthetic peptide
RKSGKIAAIVVKRPRKPKKKRKV

SEQ ID NO: 111 - protein, 16 aa, Artificial Sequence
  Description of Artificial Sequence: Synthetic peptide
KRPAATKKAGQAKKKK

SEQ ID NO: 112 - protein, 4 aa, Artificial Sequence
  Description of Artificial Sequence: Synthetic peptide
GGGS

SEQ ID NO: 113 - protein, 5 aa, Artificial Sequence
  Description of Artificial Sequence: Synthetic peptide
GGGGS

SEQ ID NO: 114 - protein, 5 aa, Artificial Sequence
  Description of Artificial Sequence: Synthetic peptide
EAAAK

SEQ ID NO: 115 - protein, 4 aa, Artificial Sequence
  Description of Artificial Sequence: Synthetic peptide
SGGS

SEQ ID NO: 116 - protein, 21 aa, Artificial Sequence
  Description of Artificial Sequence: Synthetic peptide
  MISC_FEATURE (1)..(21): This sequence may encompass 1, 3 or 7 "Gly Gly Ser" repeating units
GGSGGSGGSGGSGGSGGSGGS

SEQ ID NO: 117 - protein, 37 aa, Artificial Sequence
  Description of Artificial Sequence: Synthetic polypeptide
MVKIISRKSLGTQNVYDIGVGEPHNFLLKNGLVASNC

SEQ ID NO: 118 - DNA, 303 bp, Artificial Sequence
  Description of Artificial Sequence: Synthetic polynucleotide
tgcctgagctacgataccgagatcctgaccgtggaatacggcttcctgcctatcggcaagatcgtcgaggaacggatcgagtgcacagtgtacaccgtggataagaatggcttcgtgtacacccagcctatcgctcagtggcacaacagaggcgagcaagaggtgttcgagtactgcctggaagatggcagcatcatccgggccaccaaggaccacaagtttatgaccaccgacggccagatgctgcccatcgacgagatctttgagagaggcctggacctgaaacaggtggacggactgcct

SEQ ID NO: 119 - DNA, 111 bp, Artificial Sequence
  Description of Artificial Sequence: Synthetic polynucleotide
atggtcaagatcatcagcagaaagagcctgggcacccagaacgtgtacgatatcggagtgggcgagccccacaactttctgctcaagaatggcctggtggccagcaactgc

SEQ ID NO: 120 - DNA, 20 bp, Artificial Sequence
  Description of Artificial Sequence: Synthetic oligonucleotide
tgtcgaagttcgccctggag

SEQ ID NO: 121 - DNA, 44 bp, Artificial Sequence
  Description of Artificial Sequence: Synthetic oligonucleotide
gtcgacactgatgagtccgtgaggacgaaacgagtaagctcgtc

SEQ ID NO: 122 - DNA, 21 bp, Artificial Sequence
  Description of Artificial Sequence: Synthetic oligonucleotide
gtgtcgaagttcgccctggag

SEQ ID NO: 123 - DNA, 20 bp, Artificial Sequence
  Description of Artificial Sequence: Synthetic oligonucleotide
gaacacaaagcatagactgc

SEQ ID NO: 124 - DNA, 82 bp, Artificial Sequence
  Description of Artificial Sequence: Synthetic oligonucleotide
gttttagagctagaaatagcaagttaaaataaggctagtccgttatcaacttgaaaaagtggcaccgagtcggtgctttttt

SEQ ID NO: 125 - DNA, 146 bp, Artificial Sequence
  Description of Artificial Sequence: Synthetic polynucleotide
gtcgacactgatgagtccgtgaggacgaaacgagtaagctcgtctgtcgaagttcgccctggaggttttagagctagaaatagcaagttaaaataaggctagtccgttatcaacttgaaaaagtggcaccgagtcggtgctttttt

SEQ ID NO: 126 - DNA, 103 bp, Artificial Sequence
  Description of Artificial Sequence: Synthetic polynucleotide
gtgtcgaagttcgccctggaggttttagagctagaaatagcaagttaaaataaggctagtccgttatcaacttgaaaaagtggcaccgagtcggtgctttttt

SEQ ID NO: 127 - DNA, 102 bp, Artificial Sequence
  Description of Artificial Sequence: Synthetic polynucleotide
gaacacaaagcatagactgcgttttagagctagaaatagcaagttaaaataaggctagtccgttatcaacttgaaaaagtggcaccgagtcggtgctttttt

SEQ ID NO: 128 - DNA, 5361 bp, Artificial Sequence
  Description of Artificial Sequence: Synthetic polynucleotide
atgagcgaggtggaattcagccacgagtactggatgcggcacgccctgacactggccaaaagagcttgggacgagagggaagtgcctgtgggagctgtgctggtgcacaacaacagagtgatcggcgaaggctggaacagacccatcggcagacacgatcctacagctcacgccgagatcatggccctgagacaaggcggactggtcatgcagaactaccggctgatcgacgccacactgtacgtgaccctggaaccttgcgtgatgtgtgccggcgctatgatccacagcagaatcggcagagtggtgttcggcgccagagatgccaaaacaggcgctgccggaagcctgatggatgtgctgcatcaccccggcatgaaccacagagtggaaatcaccgagggcatcctggccgatgaatgtgccgctctgctgagcgacttcttccggatgcggcggcaagagatcaaggcccagaagaaggcccagtccagcacagatagcggcggatctagcggaggcagctctggatctgagacacctggcacaagcgagagcgccacacctgaaagttctggcggttcttctggcggcagcagcgaggtcgagttctctcacgaatattggatgagacacgctctcaccctggctaagagagccagggacgaaagagaggtgccagttggcgctgtcctggtgttgaacaatcgcgtcatcggagaaggatggaatcgcgccattggcctgcacgatccaaccgcacatgccgaaattatggctctgcggcaaggcggcctcgtgatgcaaaattacagactgatcgatgctaccctctacgtcaccttcgagccctgtgtcatgtgtgctggggcaatgattcactcccggattggccgcgtggtgtttggagtgcggaatgccaagactggcgccgctggatctctgatggacgtcctgcactatcctgggatgaaccaccgggtcgagatcacagagggaattctggctgacgagtgcgctgccctgctgtgctacttctttagaatgcccagacaggtgttcaacgcccagaaaaaagctcagagcagcaccgattccggcggaagcagcggaggatcttctggaagcgaaaccccaggcaccagcgagtctgccacaccagaatcatctggcggtagctccggcggcagcgacaagaagtattctatcggactggccatcggcaccaactctgttggatgggccgtgatcaccgacgagtacaaggtgcccagcaagaaattcaaggtgctgggcaacaccgacaggcacagcatcaagaagaacctgatcggcgcactgctgttcgactctggcgaaacagccgaggccaccagactgaagagaacagcccgcagacggtacaccagaagaaagaaccggatctgctacctccaagagatcttcagcaacgagatggccaaggtggacgacagcttcttccacagactggaagagtccttcctggtggaagaggacaagaagcacgagagacaccccatcttcggcaacatcgtggacgaggtggcctaccacgagaagtaccccaccatctaccacctgagaaagaaactggtggacagcaccgacaaggccgacctgagactgatctatctggccctggctcacatgatcaagttccggggccacttcctgatcgagggcgacctgaatcctgacaacagcgacgtggacaagctgttcatccagctggtgcagacctacaaccagctgttcgaggaaaaccccatcaacgccagcggagtggatgccaaggccatcctgtctgccagactgagcaagagcagacggctggaaaatctgatcgcccagctgcctggcgagaagaagaatggcctgttcggcaacctgattgccctgagcctgggcctgacacctaacttcaagagcaacttcgacctggccgaggacgccaaactgcagctgagcaaggacacctacgacgacgacctggacaatctgctggcccagatcggcgatcagtacgccgacttgtttctggccgccaagaatctgagcgacgccatcctgctgtccgacatcctgagagtgaacaccgagatcaccaaggcacctctgagcgcctctatgatcaagagatacgacgagcaccaccaggatctgaccctgctgaaggccctcgttagacagcagctgccagagaagtacaaagagattttcttcgaccagagcaagaacggctacgccggctacattgatggcggagccagccaagaggaattctacaagttcatcaagcccatcctcgagaagatggacggcaccgaggaactgctggtcaagctgaacagagaggacctgctgagaaagcagagaaccttcgacaacggcagcatccctcaccagatccacctgggagaactgcacgccattctgcggagacaagaggacttttacccattcctgaaggacaaccgggaaaagatcgagaaaatcctgaccttcaggatcccctactacgtgggaccactggccagaggcaatagcagattcgcctggatgaccagaaagagcgaggaaaccatcactccctggaacttcgaggaagtggtggacaagggcgccagcgctcagtccttcatcgagcggatgaccaacttcgataagaacctgcctaacgagaaggtgctgcccaagcacagcctgctgtacgagtacttcaccgtgtacaacgagctgaccaaagtgaaatacgtgaccgagggaatgagaaagcccgcctttctgagcggcgagcagaaaaaggccatcgtggatctgctgttcaagaccaaccggaaagtgaccgtgaagcagctgaaagaggactacttcaagaaaatcgagtgcttcgacagcgtcgagatctccggcgtggaagatcggttcaatgccagcctgggcacataccacgatctgctgaaaattatcaaggacaaggacttcctggacaacgaagagaacgaggacatccttgaggacatcgtgctgacactgaccctgtttgaggacagagagatgatcgaggaacggctgaaaacatacgcccacctgttcgacgacaaagtgatgaagcaactgaagcggcggagatacaccggctggggcagactgtctcggaagctgatcaacggcatccgggataagcagtccggcaagaccatcctggactttctgaagtccgacggcttcgccaacagaaacttcatgcagctgattcacgacgacagcctcaccttcaaagaggatatccagaaagcccaggtgtccggccagggcgattctctgcatgagcacattgccaacctggccggctctcccgccattaagaaaggcatcctgcagacagtgaaggtggtggacgagcttgtgaaagtgatgggcagacacaagcccgagaacatcgtgatcgaaatggccagagagaaccagaccacacagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatggacgggatatgtacgtggaccaagagctggacatcaacagactgtccgactacgatgtggaccatatcgtgccccagtcttttctgaaggacgactccatcgacaacaaggtcctgaccagatccgacaagaatcggggcaagagcgacaacgtgccctccgaagaggtggtcaagaagatgaagaactactggcgacagctgctgaacgccaagctgattacccagcggaagttcgacaatctgaccaaggccgaaagaggcggcctgagcgaactggataaggccggcttcatcaagagacagctggtggaaacccggcagatcacaaagcacgtggcacagattctggactctcggatgaacactaagtacgacgagaacgacaaactgatccgcgaagtgaaagtcatcaccctgaagtccaagctggtgtccgatttccggaaggatttccagttctacaaagtgcgcgagatcaacaactaccatcacgcccacgacgcctacctgaatgccgttgttggaacagccctgatcaaaaagtaccctaagctggaaagcgagttcgtgtacggcgactacaaggtgtacgacgtgcggaagatgatcgccaagagcgagcaagagattggcaaggcaaccgccaagtacttcttctacagcaacatcatgaactttttcaagacagagatcaccctcgccaacggcgagatcagaaagcggcctctgatcgagacaaacggcgaaaccggcgagattgtgtgggataagggcagagactttgccacagtgcggaaagtgctgagcatgccccaagtgaatatcgtgaagaaaaccgaggtgcagacaggcggcttcagcaaagagtctatcctgcctaagcggaactccgacaagctgatcgccagaaagaaggactgggaccccaagaagtacggcggcttcgattctcctaccgtggcctatagcgtgctggtggtggccaaagtggaaaagggcaagtccaagaaactcaagagcgtgaaagagctgctggggatcaccatcatggaaagaagcagcttcgagaagaatccgatcgatttcctcgaggccaagggctacaaagaagtgaaaaaggacctgatcatcaagctccccaagtactccctgttcgagctggaaaacggccggaagagaatgctggcctctgctggcgaactgcagaagggaaacgaactggccctgcctagcaaatatgtgaacttcctgtacctggccagccactatgagaagctgaagggcagccccgaggacaatgagcaaaagcagctgtttgtggaacagcacaagcactacctggacgagatcatcgagcagatcagcgagtttagcaagagagtgattctggccgacgccaatctggacaaagtgctgtccgcctacaacaagcaccgggacaagcctatcagagagcaggccgagaatatcatccacctgtttaccctgaccaacctgggagcccctgccgccttcaagtactttgacaccaccatcgaccggaagcggtacacctccaccaaagaggtgctggacgccactctgatccaccagtctatcaccggcctgtacgagacacggatcgacctgtctcaactcggaggcgacgaaggcgccgataagagaaccgccgatggctctgagttcgagagccccaagaaaaagcgcaaagtgtga

SEQ ID NO: 129 - DNA, 2400 bp, Artificial Sequence
  Description of Artificial Sequence: Synthetic polynucleotide
atgagcgaggtggaattcagccacgagtactggatgcggcacgccctgacactggccaaaagagcttgggacgagagggaagtgcctgtgggagctgtgctggtgcacaacaacagagtgatcggcgaaggctggaacagacccatcggcagacacgatcctacagctcacgccgagatcatggccctgagacaaggcggactggtcatgcagaactaccggctgatcgacgccacactgtacgtgaccctggaaccttgcgtgatgtgtgccggcgctatgatccacagcagaatcggcagagtggtgttcggcgccagagatgccaaaacaggcgctgccggaagcctgatggatgtgctgcatcaccccggcatgaaccacagagtggaaatcaccgagggcatcctggccgatgaatgtgccgctctgctgagcgacttcttccggatgcggcggcaagagatcaaggcccagaagaaggcccagtccagcacagatagcggcggatctagcggaggcagctctggatctgagacacctggcacaagcgagagcgccacacctgaaagttctggcggttcttctggcggcagcagcgaggtcgagttctctcacgaatattggatgagacacgctctcaccctggctaagagagccagggacgaaagagaggtgccagttggcgctgtcctggtgttgaacaatcgcgtcatcggagaaggatggaatcgcgccattggcctgcacgatccaaccgcacatgccgaaattatggctctgcggcaaggcggcctcgtgatgcaaaattacagactgatcgatgctaccctctacgtcaccttcgagccctgtgtcatgtgtgctggggcaatgattcactcccggattggccgcgtggtgtttggagtgcggaatgccaagactggcgccgctggatctctgatggacgtcctgcactatcctgggatgaaccaccgggtcgagatcacagagggaattctggctgacgagtgcgctgccctgctgtgctacttctttagaatgcccagacaggtgttcaacgcccagaaaaaagctcagagcagcaccgattccggcggaagcagcggaggatcttctggaagcgaaaccccaggcaccagcgagtctgccacaccagaatcatctggcggtagctccggcggcagcgacaagaagtattctatcggactggccatcggcaccaactctgttggatgggccgtgatcaccgacgagtacaaggtgcccagcaagaaattcaaggtgctgggcaacaccgacaggcacagcatcaagaagaacctgatcggcgcactgctgttcgactctggcgaaacagccgaggccaccagactgaagagaacagcccgcagacggtacaccagaagaaagaaccggatctgctacctccaagagatcttcagcaacgagatggccaaggtggacgacagcttcttccacagactggaagagtccttcctggtggaagaggacaagaagcacgagagacaccccatcttcggcaacatcgtggacgaggtggcctaccacgagaagtaccccaccatctaccacctgagaaagaaactggtggacagcaccgacaaggccgacctgagactgatctatctggccctggctcacatgatcaagttccggggccacttcctgatcgagggcgacctgaatcctgacaacagcgacgtggacaagctgttcatccagctggtgcagacctacaaccagctgttcgaggaaaaccccatcaacgccagcggagtggatgccaaggccatcctgtctgccagactgagcaagagcagacggctggaaaatctgatcgcccagctgcctggcgagaagaagaatggcctgttcggcaacctgattgccctgagcctgggcctgacacctaacttcaagagcaacttcgacctggccgaggacgccaaactgcagctgagcaaggacacctacgacgacgacctggacaatctgctggcccagatcggcgatcagtacgccgacttgtttctggccgccaagaatctgagcgacgccatcctgctgtgcctgagctacgataccgagatcctgaccgtggaatacggcttcctgcctatcggcaagatcgtcgaggaacggatcgagtgcacagtgtacaccgtggataagaatggcttcgtgtacacccagcctatcgctcagtggcacaacagaggcgagcaagaggtgttcgagtactgcctggaagatggcagcatcatccgggccaccaaggaccacaagtttatgaccaccgacggccagatgctgcccatcgacgagatctttgagagaggcctggacctgaaacaggtggacggactgccttga

SEQ ID NO: 130 - DNA, 2421 bp, Artificial Sequence
  Description of Artificial Sequence: Synthetic polynucleotide
atgagcgaggtggaattcagccacgagtactggatgcggcacgccctgacactggccaaaagagcttgggacgagagggaagtgcctgtgggagctgtgctggtgcacaacaacagagtgatcggcgaaggctggaacagacccatcggcagacacgatcctacagctcacgccgagatcatggccctgagacaaggcggactggtcatgcagaactaccggctgatcgacgccacactgtacgtgaccctggaaccttgcgtgatgtgtgccggcgctatgatccacagcagaatcggcagagtggtgttcggcgccagagatgccaaaacaggcgctgccggaagcctgatggatgtgctgcatcaccccggcatgaaccacagagtggaaatcaccgagggcatcctggccgatgaatgtgccgctctgctgagcgacttcttccggatgcggcggcaagagatcaaggcccagaagaaggcccagtccagcacagatagcggcggatctagcggaggcagctctggatctgagacacctggcacaagcgagagcgccacacctgaaagttctggcggttcttctggcggcagcagcgaggtcgagttctctcacgaatattggatgagacacgctctcaccctggctaagagagccagggacgaaagagaggtgccagttggcgctgtcctggtgttgaacaatcgcgtcatcggagaaggatggaatcgcgccattggcctgcacgatccaaccgcacatgccgaaattatggctctgcggcaaggcggcctcgtgatgcaaaattacagactgatcgatgctaccctctacgtcaccttcgagccctgtgtcatgtgtgctggggcaatgattcactcccggattggccgcgtggtgtttggagtgcggaatgccaagactggcgccgctggatctctgatggacgtcctgcactatcctgggatgaaccaccgggtcgagatcacagagggaattctggctgacgagtgcgctgccctgctgtgctacttctttagaatgcccagacaggtgttcaacgcccagaaaaaagctcagagcagcaccgattccggcggaagcagcggaggatcttctggaagcgaaaccccaggcaccagcgagtctgccacaccagaatcatctggcggtagctccggcggcagcgacaagaagtattctatcggactggccatcggcaccaactctgttggatgggccgtgatcaccgacgagtacaaggtgcccagcaagaaattcaaggtgctgggcaacaccgacaggcacagcatcaagaagaacctgatcggcgcactgctgttcgactctggcgaaacagccgaggccaccagactgaagagaacagcccgcagacggtacaccagaagaaagaaccggatctgctacctccaagagatcttcagcaacgagatggccaaggtggacgacagcttcttccacagactggaagagtccttcctggtggaagaggacaagaagcacgagagacaccccatcttcggcaacatcgtggacgaggtggcctaccacgagaagtaccccaccatctaccacctgagaaagaaactggtggacagcaccgacaaggccgacctgagactgatctatctggccctggctcacatgatcaagttccggggccacttcctgatcgagggcgacctgaatcctgacaacagcgacgtggacaagctgttcatccagctggtgcagacctacaaccagctgttcgaggaaaaccccatcaacgccagcggagtggatgccaaggccatcctgtctgccagactgagcaagagcagacggctggaaaatctgatcgcccagctgcctggcgagaagaagaatggcctgttcggcaacctgattgccctgagcctgggcctgacacctaacttcaagagcaacttcgacctggccgaggacgccaaactgcagctgagcaaggacacctacgacgacgacctggacaatctgctggcccagatcggcgatcagtacgccgacttgtttctggccgccaagaatctgagcgacgccatcctgctgtccgacatcctgagagtgaactgcctgagctacgataccgagatcctgaccgtggaatacggcttcctgcctatcggcaagatcgtcgaggaacggatcgagtgcacagtgtacaccgtggataagaatggcttcgtgtacacccagcctatcgctcagtggcacaacagaggcgagcaagaggtgttcgagtactgcctggaagatggcagcatcatccgggccaccaaggaccacaagtttatgaccaccgacggccagatgctgcccatcgacgagatctttgagagaggcctggacctgaaacaggtggacggactgccttga

SEQ ID NO: 131 - DNA, 2430 bp, Artificial Sequence
  Description of Artificial Sequence: Synthetic polynucleotide
atgagcgaggtggaattcagccacgagtactggatgcggcacgccctgacactggccaaaagagcttgggacgagagggaagtgcctgtgggagctgtgctggtgcacaacaacagagtgatcggcgaaggctggaacagacccatcggcagacacgatcctacagctcacgccgagatcatggccctgagacaaggcggactggtcatgcagaactaccggctgatcgacgccacactgtacgtgaccctggaaccttgcgtgatgtgtgccggcgctatgatccacagcagaatcggcagagtggtgttcggcgccagagatgccaaaacaggcgctgccggaagcctgatggatgtgctgcatcaccccggcatgaaccacagagtggaaatcaccgagggcatcctggccgatgaatgtgccgctctgctgagcgacttcttccggatgcggcggcaagagatcaaggcccagaagaaggcccagtccagcacagatagcggcggatctagcggaggcagctctggatctgagacacctggcacaagcgagagcgccacacctgaaagttctggcggttcttctggcggcagcagcgaggtcgagttctctcacgaatattggatgagacacgctctcaccctggctaagagagccagggacgaaagagaggtgccagttggcgctgtcctggtgttgaacaatcgcgtcatcggagaaggatggaatcgcgccattggcctgcacgatccaaccgcacatgccgaaattatggctctgcggcaaggcggcctcgtgatgcaaaattacagactgatcgatgctaccctctacgtcaccttcgagccctgtgtcatgtgtgctggggcaatgattcactcccggattggccgcgtggtgtttggagtgcggaatgccaagactggcgccgctggatctctgatggacgtcctgcactatcctgggatgaaccaccgggtcgagatcacagagggaattctggctgacgagtgcgctgccctgctgtgctacttctttagaatgcccagacaggtgttcaacgcccagaaaaaagctcagagcagcaccgattccggcggaagcagcggaggatcttctggaagcgaaaccccaggcaccagcgagtctgccacaccagaatcatctggcggtagctccggcggcagcgacaagaagtattctatcggactggccatcggcaccaactctgttggatgggccgtgatcaccgacgagtacaaggtgcccagcaagaaattcaaggtgctgggcaacaccgacaggcacagcatcaagaagaacctgatcggcgcactgctgttcgactctggcgaaacagccgaggccaccagactgaagagaacagcccgcagacggtacaccagaagaaagaaccggatctgctacctccaagagatcttcagcaacgagatggccaaggtggacgacagcttcttccacagactggaagagtccttcctggtggaagaggacaagaagcacgagagacaccccatcttcggcaacatcgtggacgaggtggcctaccacgagaagtaccccaccatctaccacctgagaaagaaactggtggacagcaccgacaaggccgacctgagactgatctatctggccctggctcacatgatcaagttccggggccacttcctgatcgagggcgacctgaatcctgacaacagcgacgtggacaagctgttcatccagctggtgcagacctacaaccagctgttcgaggaaaaccccatcaacgccagcggagtggatgccaaggccatcctgtctgccagactgagcaagagcagacggctggaaaatctgatcgcccagctgcctggcgagaagaagaatggcctgttcggcaacctgattgccctgagcctgggcctgacacctaacttcaagagcaacttcgacctggccgaggacgccaaactgcagctgagcaaggacacctacgacgacgacctggacaatctgctggcccagatcggcgatcagtacgccgacttgtttctggccgccaagaatctgagcgacgccatcctgctgtccgacatcctgagagtgaacaccgagatctgcctgagctacgataccgagatcctgaccgtggaatacggcttcctgcctatcggcaagatcgtcgaggaacggatcgagtgcacagtgtacaccgtggataagaatggcttcgtgtacacccagcctatcgctcagtggcacaacagaggcgagcaagaggtgttcgagtactgcctggaagatggcagcatcatccgggccaccaaggaccacaagtttatgaccaccgacggccagatgctgcccatcgacgagatctttgagagaggcctggacctgaaacaggtggacggactgccttga

SEQ ID NO: 132 - DNA, 2556 bp, Artificial Sequence
  Description of Artificial Sequence: Synthetic polynucleotide
atgagcgaggtggaattcagccacgagtactggatgcggcacgccctgacactggccaaaagagcttgggacgagagggaagtgcctgtgggagctgtgctggtgcacaacaacagagtgatcggcgaaggctggaacagacccatcggcagacacgatcctacagctcacgccgagatcatggccctgagacaaggcggactggtcatgcagaactaccggctgatcgacgccacactgtacgtgaccctggaaccttgcgtgatgtgtgccggcgctatgatccacagcagaatcggcagagtggtgttcggcgccagagatgccaaaacaggcgctgccggaagcctgatggatgtgctgcatcaccccggcatgaaccacagagtggaaatcaccgagggcatcctggccgatgaatgtgccgctctgctgagcgacttcttccggatgcggcggcaagagatcaaggcccagaagaaggcccagtccagcacagatagcggcggatctagcggaggcagctctggatctgagacacctggcacaagcgagagcgccacacctgaaagttctggcggttcttctggcggcagcagcgaggtcgagttctctcacgaatattggatgagacacgctctcaccctggctaagagagccagggacgaaagagaggtgccagttggcgctgtcctggtgttgaacaatcgcgtcatcggagaaggatggaatcgcgccattggcctgcacgatccaaccgcacatgccgaaattatggctctgcggcaaggcggcctcgtgatgcaaaattacagactgatcgatgctaccctctacgtcaccttcgagccctgtgtcatgtgtgctggggcaatgattcactcccggattggccgcgtggtgtttggagtgcggaatgccaagactggcgccgctggatctctgatggacgtcctgcactatcctgggatgaaccaccgggtcgagatcacagagggaattctggctgacgagtgcgctgccctgctgtgctacttctttagaatgcccagacaggtgttcaacgcccagaaaaaagctcagagcagcaccgattccggcggaagcagcggaggatcttctggaagcgaaaccccaggcaccagcgagtctgccacaccagaatcatctggcggtagctccggcggcagcgacaagaagtattctatcggactggccatcggcaccaactctgttggatgggccgtgatcaccgacgagtacaaggtgcccagcaagaaattcaaggtgctgggcaacaccgacaggcacagcatcaagaagaacctgatcggcgcactgctgttcgactctggcgaaacagccgaggccaccagactgaagagaacagcccgcagacggtacaccagaagaaagaaccggatctgctacctccaagagatcttcagcaacgagatggccaaggtggacgacagcttcttccacagactggaagagtccttcctggtggaagaggacaagaagcacgagagacaccccatcttcggcaacatcgtggacgaggtggcctaccacgagaagtaccccaccatctaccacctgagaaagaaactggtggacagcaccgacaaggccgacctgagactgatctatctggccctggctcacatgatcaagttccggggccacttcctgatcgagggcgacctgaatcctgacaacagcgacgtggacaagctgttcatccagctggtgcagacctacaaccagctgttcgaggaaaaccccatcaacgccagcggagtggatgccaaggccatcctgtctgccagactgagcaagagcagacggctggaaaatctgatcgcccagctgcctggcgagaagaagaatggcctgttcggcaacctgattgccctgagcctgggcctgacacctaacttcaagagcaacttcgacctggccgaggacgccaaactgcagctgagcaaggacacctacgacgacgacctggacaatctgctggcccagatcggcgatcagtacgccgacttgtttctggccgccaagaatctgagcgacgccatcctgctgtccgacatcctgagagtgaacaccgagatcaccaaggcacctctgagcgcctctatgatcaagagatacgacgagcaccaccaggatctgaccctgctgaaggccctcgttagacagcagctgccagagaagtacaaagagattttcttcgaccagtgcctgagctacgataccgagatcctgaccgtggaatacggcttcctgcctatcggcaagatcgtcgaggaacggatcgagtgcacagtgtacaccgtggataagaatggcttcgtgtacacccagcctatcgctcagtggcacaacagaggcgagcaagaggtgttcgagtactgcctggaagatggcagcatcatccgggccaccaaggaccacaagtttatgaccaccgacggccagatgctgcccatcgacgagatctttgagagaggcctggacctgaaacaggtggacggactgccttga

SEQ ID NO: 133 - DNA, 2859 bp, Artificial Sequence
  Description of Artificial Sequence: Synthetic polynucleotide
atgagcgaggtggaattcagccacgagtactggatgcggcacgccctgacactggccaaaagagcttgggacgagagggaagtgcctgtgggagctgtgctggtgcacaacaacagagtgatcggcgaaggctggaacagacccatcggcagacacgatcctacagctcacgccgagatcatggccctgagacaaggcggactggtcatgcagaactaccggctgatcgacgccacactgtacgtgaccctggaaccttgcgtgatgtgtgccggcgctatgatccacagcagaatcggcagagtggtgttcggcgccagagatgccaaaacaggcgctgccggaagcctgatggatgtgctgcatcaccccggcatgaaccacagagtggaaatcaccgagggcatcctggccgatgaatgtgccgctctgctgagcgacttcttccggatgcggcggcaagagatcaaggcccagaagaaggcccagtccagcacagatagcggcggatctagcggaggcagctctggatctgagacacctggcacaagcgagagcgccacacctgaaagttctggcggttcttctggcggcagcagcgaggtcgagttctctcacgaatattggatgagacacgctctcaccctggctaagagagccagggacgaaagagaggtgccagttggcgctgtcctggtgttgaacaatcgcgtcatcggagaaggatggaatcgcgccattggcctgcacgatccaaccgcacatgccgaaattatggctctgcggcaaggcggcctcgtgatgcaaaattacagactgatcgatgctaccctctacgtcaccttcgagccctgtgtcatgtgtgctggggcaatgattcactcccggattggccgcgtggtgtttggagtgcggaatgccaagactggcgccgctggatctctgatggacgtcctgcactatcctgggatgaaccaccgggtcgagatcacagagggaattctggctgacgagtgcgctgccctgctgtgctacttctttagaatgcccagacaggtgttcaacgcccagaaaaaagctcagagcagcaccgattccggcggaagcagcggaggatcttctggaagcgaaaccccaggcaccagcgagtctgccacaccagaatcatctggcggtagctccggcggcagcgacaagaagtattctatcggactggccatcggcaccaactctgttggatgggccgtgatcaccgacgagtacaaggtgcccagcaagaaattcaaggtgctgggcaacaccgacaggcacagcatcaagaagaacctgatcggcgcactgctgttcgactctggcgaaacagccgaggccaccagactgaagagaacagcccgcagacggtacaccagaagaaagaaccggatctgctacctccaagagatcttcagcaacgagatggccaaggtggacgacagcttcttccacagactggaagagtccttcctggtggaagaggacaagaagcacgagagacaccccatcttcggcaacatcgtggacgaggtggcctaccacgagaagtaccccaccatctaccacctgagaaagaaactggtggacagcaccgacaaggccgacctgagactgatctatctggccctggctcacatgatcaagttccggggccacttcctgatcgagggcgacctgaatcctgacaacagcgacgtggacaagctgttcatccagctggtgcagacctacaaccagctgttcgaggaaaaccccatcaacgccagcggagtggatgccaaggccatcctgtctgccagactgagcaagagcagacggctggaaaatctgatcgcccagctgcctggcgagaagaagaatggcctgttcggcaacctgattgccctgagcctgggcctgacacctaacttcaagagcaacttcgacctggccgaggacgccaaactgcagctgagcaaggacacctacgacgacgacctggacaatctgctggcccagatcggcgatcagtacgccgacttgtttctggccgccaagaatctgagcgacgccatcctgctgtccgacatcctgagagtgaacaccgagatcaccaaggcacctctgagcgcctctatgatcaagagatacgacgagcaccaccaggatctgaccctgctgaaggccctcgttagacagcagctgccagagaagtacaaagagattttcttcgaccagagcaagaacggctacgccggctacattgatggcggagccagccaagaggaattctacaagttcatcaagcccatcctcgagaagatggacggcaccgaggaactgctggtcaagctgaacagagaggacctgctgagaaagcagagaaccttcgacaacggcagcatccctcaccagatccacctgggagaactgcacgccattctgcggagacaagaggacttttacccattcctgaaggacaaccgggaaaagatcgagaaaatcctgaccttcaggatcccctactacgtgggaccactgtgcctgagctacgataccgagatcctgaccgtggaatacggcttcctgcctatcggcaagatcgtcgaggaacggatcgagtgcacagtgtacaccgtggataagaatggcttcgtgtacacccagcctatcgctcagtggcacaacagaggcgagcaagaggtgttcgagtactgcctggaagatggcagcatcatccgggccaccaaggaccacaagtttatgaccaccgacggccagatgctgcccatcgacgagatctttgagagaggcctggacctgaaacaggtggacggactgccttga

SEQ ID NO: 134 - DNA, 2871 bp, Artificial Sequence
  Description of Artificial Sequence: Synthetic polynucleotide
atgagcgaggtggaattcagccacgagtactggatgcggcacgccctgacactggccaaaagagcttgggacgagagggaagtgcctgtgggagctgtgctggtgcacaacaacagagtgatcggcgaaggctggaacagacccatcggcagacacgatcctacagctcacgccgagatcatggccctgagacaaggcggactggtcatgcagaactaccggctgatcgacgccacactgtacgtgaccctggaaccttgcgtgatgtgtgccggcgctatgatccacagcagaatcggcagagtggtgttcggcgccagagatgccaaaacaggcgctgccggaagcctgatggatgtgctgcatcaccccggcatgaaccacagagtggaaatcaccgagggcatcctggccgatgaatgtgccgctctgctgagcgacttcttccggatgcggcggcaagagatcaaggcccagaagaaggcccagtccagcacagatagcggcggatctagcggaggcagctctggatctgagacacctggcacaagcgagagcgccacacctgaaagttctggcggttcttctggcggcagcagcgaggtcgagttctctcacgaatattggatgagacacgctctcaccctggctaagagagccagggacgaaagagaggtgccagttggcgctgtcctggtgttgaacaatcgcgtcatcggagaaggatggaatcgcgccattggcctgcacgatccaaccgcacatgccgaaattatggctctgcggcaaggcggcctcgtgatgcaaaattacagactgatcgatgctaccctctacgtcaccttcgagccctgtgtcatgtgtgctggggcaatgattcactcccggattggccgcgtggtgtttggagtgcggaatgccaagactggcgccgctggatctctgatggacgtcctgcactatcctgggatgaaccaccgggtcgagatcacagagggaattctggctgacgagtgcgctgccctgctgtgctacttctttagaatgcccagacaggtgttcaacgcccagaaaaaagctcagagcagcaccgattccggcggaagcagcggaggatcttctggaagcgaaaccccaggcaccagcgagtctgccacaccagaatcatctggcggtagctccggcggcagcgacaagaagtattctatcggactggccatcggcaccaactctgttggatgggccgtgatcaccgacgagtacaaggtgcccagcaagaaattcaaggtgctgggcaacaccgacaggcacagcatcaagaagaacctgatcggcgcactgctgttcgactctggcgaaacagccgaggccaccagactgaagagaacagcccgcagacggtacaccagaagaaagaaccggatctgctacctccaagagatcttcagcaacgagatggccaaggtggacgacagcttcttccacagactggaagagtccttcctggtggaagaggacaagaagcacgagagacaccccatcttcggcaacatcgtggacgaggtggcctaccacgagaagtaccccaccatctaccacctgagaaagaaactggtggacagcaccgacaaggccgacctgagactgatctatctggccctggctcacatgatcaagttccggggccacttcctgatcgagggcgacctgaatcctgacaacagcgacgtggacaagctgttcatccagctggtgcagacctacaaccagctgttcgaggaaaaccccatcaacgccagcggagtggatgccaaggccatcctgtctgccagactgagcaagagcagacggctggaaaatctgatcgcccagctgcctggcgagaagaagaatggcctgttcggcaacctgattgccctgagcctgggcctgacacctaacttcaagagcaacttcgacctggccgaggacgccaaactgcagctgagcaaggacacctacgacgacgacctggacaatctgctggcccagatcggcgatcagtacgccgacttgtttctggccgccaagaatctgagcgacgccatcctgctgtccgacatcctgagagtgaacaccgagatcaccaaggcacctctgagcgcctctatgatcaagagatacgacgagcaccaccaggatctgaccctgctgaaggccctcgttagacagcagctgccagagaagtacaaagagattttcttcgaccagagcaagaacggctacgccggctacattgatggcggagccagccaagaggaattctacaagttcatcaagcccatcctcgagaagatggacggcaccgaggaactgctggtcaagctgaacagagaggacctgctgagaaagcagagaaccttcgacaacggcagcatccctcaccagatccacctgggagaactgcacgccattctgcggagacaagaggacttttacccattcctgaaggacaaccgggaaaagatcgagaaaatcctgaccttcaggatcccctactacgtgggaccactggccagaggcaattgcctgagctacgataccgagatcctgaccgtggaatacggcttcctgcctatcggcaagatcgtcgaggaacggatcgagtgcacagtgtacaccgtggataagaatggcttcgtgtacacccagcctatcgctcagtggcacaacagaggcgagcaagaggtgttcgagtactgcctggaagatggcagcatcatccgggccaccaaggaccacaagtttatgaccaccgacggccagatgctgcccatcgacgagatctttgagagaggcctggacctgaaacaggtggacggactgccttga

SEQ ID NO: 135 - DNA, 2880 bp, Artificial Sequence
  Description of Artificial Sequence: Synthetic polynucleotide
atgagcgaggtggaattcagccacgagtactggatgcggcacgccctgacactggccaaaagagcttgggacgagagggaagtgcctgtgggagctgtgctggtgcacaacaacagagtgatcggcgaaggctggaacagacccatcggcagacacgatcctacagctcacgccgagatcatggccctgagacaaggcggactggtcatgcagaactaccggctgatcgacgccacactgtacgtgaccctggaaccttgcgtgatgtgtgccggcgctatgatccacagcagaatcggcagagtggtgttcggcgccagagatgccaaaacaggcgctgccggaagcctgatggatgtgctgcatcaccccggcatgaaccacagagtggaaatcaccgagggcatcctggccgatgaatgtgccgctctgctgagcgacttcttccggatgcggcggcaagagatcaaggcccagaagaaggcccagtccagcacagatagcggcggatctagcggaggcagctctggatctgagacacctggcacaagcgagagcgccacacctgaaagttctggcggttcttctggcggcagcagcgaggtcgagttctctcacgaatattggatgagacacgctctcaccctggctaagagagccagggacgaaagagaggtgccagttggcgctgtcctggtgttgaacaatcgcgtcatcggagaaggatggaatcgcgccattggcctgcacgatccaaccgcacatgccgaaattatggctctgcggcaaggcggcctcgtgatgcaaaattacagactgatcgatgctaccctctacgtcaccttcgagccctgtgtcatgtgtgctggggcaatgattcactcccggattggccgcgtggtgtttggagtgcggaatgccaagactggcgccgctggatctctgatggacgtcctgcactatcctgggatgaaccaccgggtcgagatcacagagggaattctggctgacgagtgcgctgccctgctgtgctacttctttagaatgcccagacaggtgttcaacgcccagaaaaaagctcagagcagcaccgattccggcggaagcagcggaggatcttctggaagcgaaaccccaggcaccagcgagtctgccacaccagaatcatctggcggtagctccggcggcagcgacaagaagtattctatcggactggccatcggcaccaactctgttggatgggccgtgatcaccgacgagtacaaggtgcccagcaagaaattcaaggtgctgggcaacaccgacaggcacagcatcaagaagaacctgatcggcgcactgctgttcgactctggcgaaacagccgaggccaccagactgaagagaacagcccgcagacggtacaccagaagaaagaaccggatctgctacctccaagagatcttcagcaacgagatggccaaggtggacgacagcttcttccacagactggaagagtccttcctggtggaagaggacaagaagcacgagagacaccccatcttcggcaacatcgtggacgaggtggcctaccacgagaagtaccccaccatctaccacctgagaaagaaactggtggacagcaccgacaaggccgacctgagactgatctatctggccctggctcacatgatcaagttccggggccacttcctgatcgagggcgacctgaatcctgacaacagcgacgtggacaagctgttcatccagctggtgcagacctacaaccagctgttcgaggaaaaccccatcaacgccagcggagtggatgccaaggccatcctgtctgccagactgagcaagagcagacggctggaaaatctgatcgcccagctgcctggcgagaagaagaatggcctgttcggcaacctgattgccctgagcctgggcctgacacctaacttcaagagcaacttcgacctggccgaggacgccaaactgcagctgagcaaggacacctacgacgacgacctggacaatctgctggcccagatcggcgatcagtacgccgacttgtttctggccgccaagaatctgagcgacgccatcctgctgtccgacatcctgagagtgaacaccgagatcaccaaggcacctctgagcgcctctatgatcaagagatacgacgagcaccaccaggatctgaccctgctgaaggccctcgttagacagcagctgccagagaagtacaaagagattttcttcgaccagagcaagaacggctacgccggctacattgatggcggagccagccaagaggaattctacaagttcatcaagcccatcctcgagaagatggacggcaccgaggaactgctggtcaagctgaacagagaggacctgctgagaaagcagagaaccttcgacaacggcagcatccctcaccagatccacctgggagaactgcacgccattctgcggagacaagaggacttttacccattcctgaaggacaaccgggaaaagatcgagaaaatcctgaccttcaggatcccctactacgtgggaccactggccagaggcaatagcagattctgcctgagctacgataccgagatcctgaccgtggaatacggcttcctgcctatcggcaagatcgtcgaggaacggatcgagtgcacagtgtacaccgtggataagaatggcttcgtgtacacccagcctatcgctcagtggcacaacagaggcgagcaagaggtgttcgagtactgcctggaagatggcagcatcatccgggccaccaaggaccacaagtttatgaccaccgacggccagatgctgcccatcgacgagatctttgagagaggcctggacctgaaacaggtggacggactgccttga

SEQ ID NO: 136 - DNA, 2889 bp, Artificial Sequence
  Description of Artificial Sequence: Synthetic polynucleotide
atgagcgaggtggaattcagccacgagtactggatgcggcacgccctgacactggccaaaagagcttgggacgagagggaagtgcctgtgggagctgtgctggtgcacaacaacagagtgatcggcgaaggctggaacagacccatcggcagacacgatcctacagctcacgccgagatcatggccctgagacaaggcggactggtcatgcagaactaccggctgatcgacgccacactgtacgtgaccctggaaccttgcgtgatgtgtgccggcgctatgatccacagcagaatcggcagagtggtgttcggcgccagagatgccaaaacaggcgctgccggaagcctgatggatgtgctgcatcaccccggcatgaaccacagagtggaaatcaccgagggcatcctggccgatgaatgtgccgctctgctgagcgacttcttccggatgcggcggcaagagatcaaggcccagaagaaggcccagtccagcacagatagcggcggatctagcggaggcagctctggatctgagacacctggcacaagcgagagcgccacacctgaaagttctggcggttcttctggcggcagcagcgaggtcgagttctctcacgaatattggatgagacacgctctcaccctggctaagagagccagggacgaaagagaggtgccagttggcgctgtcctggtgttgaacaatcgcgtcatcggagaaggatggaatcgcgccattggcctgcacgatccaaccgcacatgccgaaattatggctctgcggcaaggcggcctcgtgatgcaaaattacagactgatcgatgctaccctctacgtcaccttcgagccctgtgtcatgtgtgctggggcaatgattcactcccggattggccgcgtggtgtttggagtgcggaatgccaagactggcgccgctggatctctgatggacgtcctgcactatcctgggatgaaccaccgggtcgagatcacagagggaattctggctgacgagtgcgctgccctgctgtgctacttctttagaatgcccagacaggtgttcaacgcccagaaaaaagctcagagcagcaccgattccggcggaagcagcggaggatcttctggaagcgaaaccccaggcaccagcgagtctgccacaccagaatcatctggcggtagctccggcggcagcgacaagaagtattctatcggactggccatcggcaccaactctgttggatgggccgtgatcaccgacgagtacaaggtgcccagcaagaaattcaaggtgctgggcaacaccgacaggcacagcatcaagaagaacctgatcggcgcactgctgttcgactctggcgaaacagccgaggccaccagactgaagagaacagcccgcagacggtacaccagaagaaagaaccggatctgctacctccaagagatcttcagcaacgagatggccaaggtggacgacagcttcttccacagactggaagagtccttcctggtggaagaggacaagaagcacgagagacaccccatcttcggcaacatcgtggacgaggtggcctaccacgagaagtaccccaccatctaccacctgagaaagaaactggtggacagcaccgacaaggccgacctgagactgatctatctggccctggctcacatgatcaagttccggggccacttcctgatcgagggcgacctgaatcctgacaacagcgacgtggacaagctgttcatccagctggtgcagacctacaaccagctgttcgaggaaaaccccatcaacgccagcggagtggatgccaaggccatcctgtctgccagactgagcaagagcagacggctggaaaatctgatcgcccagctgcctggcgagaagaagaatggcctgttcggcaacctgattgccctgagcctgggcctgacacctaacttcaagagcaacttcgacctggccgaggacgccaaactgcagctgagcaaggacacctacgacgacgacctggacaatctgctggcccagatcggcgatcagtacgccgacttgtttctggccgccaagaatctgagcgacgccatcctgctgtccgacatcctgagagtgaacaccgagatcaccaaggcacctctgagcgcctctatgatcaagagatacgacgagcaccaccaggatctgaccctgctgaaggccctcgttagacagcagctgccagagaagtacaaagagattttcttcgaccagagcaagaacggctacgccggctacattgatggcggagccagccaagaggaattctacaagttcatcaagcccatcctcgagaagatggacggcaccgaggaactgctggtcaagctgaacagagaggacctgctgagaaagcagagaaccttcgacaacggcagcatccctcaccagatccacctgggagaactgcacgccattctgcggagacaagaggacttttacccattcctgaaggacaaccgggaaaagatcgagaaaatcctgaccttcaggatcccctactacgtgggaccactggccagaggcaatagcagattcgcctggatgtgcctgagctacgataccgagatcctgaccgtggaatacggcttcctgcctatcggcaagatcgtcgaggaacggatcgagtgcacagtgtacaccgtggataagaatggcttcgtgtacacccagcctatcgctcagtggcacaacagaggcgagcaagaggtgttcgagtactgcctggaagatggcagcatcatccgggccaccaaggaccacaagtttatgaccaccgacggccagatgctgcccatcgacgagatctttgagagaggcctggacctgaaacaggtggacggactgccttga

SEQ ID NO: 137 - DNA, 2898 bp, Artificial Sequence
  Description of Artificial Sequence: Synthetic polynucleotide
atgagcgaggtggaattcagccacgagtactggatgcggcacgccctgacactggccaaaagagcttgggacgagagggaagtgcctgtgggagctgtgctggtgcacaacaacagagtgatcggcgaaggctggaacagacccatcggcagacacgatcctacagctcacgccgagatcatggccctgagacaaggcggactggtcatgcagaactaccggctgatcgacgccacactgtacgtgaccctggaaccttgcgtgatgtgtgccggcgctatgatccacagcagaatcggcagagtggtgttcggcgccagagatgccaaaacaggcgctgccggaagcctgatggatgtgctgcatcaccccggcatgaaccacagagtggaaatcaccgagggcatcctggccgatgaatgtgccgctctgctgagcgacttcttccggatgcggcggcaagagatcaaggcccagaagaaggcccagtccagcacagatagcggcggatctagcggaggcagctctggatctgagacacctggcacaagcgagagcgccacacctgaaagttctggcggttcttctggcggcagcagcgaggtcgagttctctcacgaatattggatgagacacgctctcaccctggctaagagagccagggacgaaagagaggtgccagttggcgctgtcctggtgttgaacaatcgcgtcatcggagaaggatggaatcgcgccattggcctgcacgatccaaccgcacatgccgaaattatggctctgcggcaaggcggcctcgtgatgcaaaattacagactgatcgatgctaccctctacgtcaccttcgagccctgtgtcatgtgtgctggggcaatgattcactcccggattggccgcgtggtgtttggagtgcggaatgccaagactggcgccgctggatctctgatggacgtcctgcactatcctgggatgaaccaccgggtcgagatcacagagggaattctggctgacgagtgcgctgccctgctgtgctacttctttagaatgcccagacaggtgttcaacgcccagaaaaaagctcagagcagcaccgattccggcggaagcagcggaggatcttctggaagcgaaaccccaggcaccagcgagtctgccacaccagaatcatctggcggtagctccggcggcagcgacaagaagtattctatcggactggccatcggcaccaactctgttggatgggccgtgatcaccgacgagtacaaggtgcccagcaagaaattcaaggtgctgggcaacaccgacaggcacagcatcaagaagaacctgatcggcgcactgctgttcgactctggcgaaacagccgaggccaccagactgaagagaacagcccgcagacggtacaccagaagaaagaaccggatctgctacctccaagagatcttcagcaacgagatggccaaggtggacgacagcttcttccacagactggaagagtccttcctggtggaagaggacaagaagcacgagagacaccccatcttcggcaacatcgtggacgaggtggcctaccacgagaagtaccccaccatctaccacctgagaaagaaactggtggacagcaccgacaaggccgacctgagactgatctatctggccctggctcacatgatcaagttccggggccacttcctgatcgagggcgacctgaatcctgacaacagcgacgtggacaagctgttcatccagctggtgcagacctacaaccagctgttcgaggaaaaccccatcaacgccagcggagtggatgccaaggccatcctgtctgccagactgagcaagagcagacggctggaaaatctgatcgcccagctgcctggcgagaagaagaatggcctgttcggcaacctgattgccctgagcctgggcctgacacctaacttcaagagcaacttcgacctggccgaggacgccaaactgcagctgagcaaggacacctacgacgacgacctggacaatctgctggcccagatcggcgatcagtacgccgacttgtttctggccgccaagaatctgagcgacgccatcctgctgtccgacatcctgagagtgaacaccgagatcaccaaggcacctctgagcgcctctatgatcaagagatacgacgagcaccaccaggatctgaccctgctgaaggccctcgttagacagcagctgccagagaagtacaaagagattttcttcgaccagagcaagaacggctacgccggctacattgatggcggagccagccaagaggaattctacaagttcatcaagcccatcctcgagaagatggacggcaccgaggaactgctggtcaagctgaacagagaggacctgctgagaaagcagagaaccttcgacaacggcagcatccctcaccagatccacctgggagaactgcacgccattctgcggagacaagaggacttttacccattcctgaaggacaaccgggaaaagatcgagaaaatcctgaccttcaggatcccctactacgtgggaccactggccagaggcaatagcagattcgcctggatgaccagaaagtgcctgagctacgataccgagatcctgaccgtggaatacggcttcctgcctatcggcaagatcgtcgaggaacggatcgagtgcacagtgtacaccgtggataagaatggcttcgtgtacacccagcctatcgctcagtggcacaacagaggcgagcaagaggtgttcgagtactgcctggaagatggcagcatcatccgggccaccaaggaccacaagtttatgaccaccgacggccagatgctgcccatcgacgagatctttgagagaggcctggacctgaaacaggtggacggactgccttga

SEQ ID NO: 138 - DNA, 2907 bp, Artificial Sequence
  Description of Artificial Sequence: Synthetic polynucleotide
atgagcgaggtggaattcagccacgagtactggatgcggcacgccctgacactggccaaaagagcttgggacgagagggaagtgcctgtgggagctgtgctggtgcacaacaacagagtgatcggcgaaggctggaacagacccatcggcagacacgatcctacagctcacgccgagatcatggccctgagacaaggcggactggtcatgcagaactaccggctgatcgacgccacactgtacgtgaccctggaaccttgcgtgatgtgtgccggcgctatgatccacagcagaatcggcagagtggtgttcggcgccagagatgccaaaacaggcgctgccggaagcctgatggatgtgctgcatcaccccggcatgaaccacagagtggaaatcaccgagggcatcctggccgatgaatgtgccgctctgctgagcgacttcttccggatgcggcggcaagagatcaaggcccagaagaaggcccagtccagcacagatagcggcggatctagcggaggcagctctggatctgagacacctggcacaagcgagagcgccacacctgaaagttctggcggttcttctggcggcagcagcgaggtcgagttctctcacgaatattggatgagacacgctctcaccctggctaagagagccagggacgaaagagaggtgccagttggcgctgtcctggtgttgaacaatcgcgtcatcggagaaggatggaatcgcgccattggcctgcacgatccaaccgcacatgccgaaattatggctctgcggcaaggcggcctcgtgatgcaaaattacagactgatcgatgctaccctctacgtcaccttcgagccctgtgtcatgtgtgctggggcaatgattcactcccggattggccgcgtggtgtttggagtgcggaatgccaagactggcgccgctggatctctgatggacgtcctgcactatcctgggatgaaccaccgggtcgagatcacagagggaattctggctgacgagtgcgctgccctgctgtgctacttctttagaatgcccagacaggtgttcaacgcccagaaaaaagctcagagcagcaccgattccggcggaagcagcggaggatcttctggaagcgaaaccccaggcaccagcgagtctgccacaccagaatcatctggcggtagctccggcggcagcgacaagaagtattctatcggactggccatcggcaccaactctgttggatgggccgtgatcaccgacgagtacaaggtgcccagcaagaaattcaaggtgctgggcaacaccgacaggcacagcatcaagaagaacctgatcggcgcactgctgttcgactctggcgaaacagccgaggccaccagactgaagagaacagcccgcagacggtacaccagaagaaagaaccggatctgctacctccaagagatcttcagcaacgagatggccaaggtggacgacagcttcttccacagactggaagagtccttcctggtggaagaggacaagaagcacgagagacaccccatcttcggcaacatcgtggacgaggtggcctaccacgagaagtaccccaccatctaccacctgagaaagaaactggtggacagcaccgacaaggccgacctgagactgatctatctggccctggctcacatgatcaagttccggggccacttcctgatcgagggcgacctgaatcctgacaacagcgacgtggacaagctgttcatccagctggtgcagacctacaaccagctgttcgaggaaaaccccatcaacgccagcggagtggatgccaaggccatcctgtctgccagactgagcaagagcagacggctggaaaatctgatcgcccagctgcctggcgagaagaagaatggcctgttcggcaacctgattgccctgagcctgggcctgacacctaacttcaagagcaacttcgacctggccgaggacgccaaactgcagctgagcaaggacacctacgacgacgacctggacaatctgctggcccagatcggcgatcagtacgccgacttgtttctggccgccaagaatctgagcgacgccatcctgctgtccgacatcctgagagtgaacaccgagatcaccaaggcacctctgagcgcctctatgatcaagagatacgacgagcaccaccaggatctgaccctgctgaaggccctcgttagacagcagctgccagagaagtacaaagagattttcttcgaccagagcaagaacggctacgccggctacattgatggcggagccagccaagaggaattctacaagttcatcaagcccatcctcgagaagatggacggcaccgaggaactgctggtcaagctgaacagagaggacctgctgagaaagcagagaaccttcgacaacggcagcatccctcaccagatccacctgggagaactgcacgccattctgcggagacaagaggacttttacccattcctgaaggacaaccgggaaaagatcgagaaaatcctgaccttcaggatcccctactacgtgggaccactggccagaggcaatagcagattcgcctggatgaccagaaagagcgaggaatgcctgagctacgataccgagatcctgaccgtggaatacggcttcctgcctatcggcaagatcgtcgaggaacggatcgagtgcacagtgtacaccgtggataagaatggcttcgtgtacacccagcctatcgctcagtggcacaacagaggcgagcaagaggtgttcgagtactgcctggaagatggcagcatcatccgggccaccaaggaccacaagtttatgaccaccgacggccagatgctgcccatcgacgagatctttgagagaggcctggacctgaaacaggtggacggactgccttga

SEQ ID NO: 139 - DNA, 2913 bp, Artificial Sequence
  Description of Artificial Sequence: Synthetic polynucleotide
atgagcgaggtggaattcagccacgagtactggatgcggcacgccctgacactggccaaaagagcttgggacgagagggaagtgcctgtgggagctgtgctggtgcacaacaacagagtgatcggcgaaggctggaacagacccatcggcagacacgatcctacagctcacgccgagatcatggccctgagacaaggcggactggtcatgcagaactaccggctgatcgacgccacactgtacgtgaccctggaaccttgcgtgatgtgtgccggcgctatgatccacagcagaatcggcagagtggtgttcggcgccagagatgccaaaacaggcgctgccggaagcctgatggatgtgctgcatcaccccggcatgaaccacagagtggaaatcaccgagggcatcctggccgatgaatgtgccgctctgctgagcgacttcttccggatgcggcggcaagagatcaaggcccagaagaaggcccagtccagcacagatagcggcggatctagcggaggcagctctggatctgagacacctggcacaagcgagagcgccacacctgaaagttctggcggttcttctggcggcagcagcgaggtcgagttctctcacgaatattggatgagacacgctctcaccctggctaagagagccagggacgaaagagaggtgccagttggcgctgtcctggtgttgaacaatcgcgtcatcggagaaggatggaatcgcgccattggcctgcacgatccaaccgcacatgccgaaattatggctctgcggcaaggcggcctcgtgatgcaaaattacagactgatcgatgctaccctctacgtcaccttcgagccctgtgtcatgtgtgctggggcaatgattcactcccggattggccgcgtggtgtttggagtgcggaatgccaagactggcgccgctggatctctgatggacgtcctgcactatcctgggatgaaccaccgggtcgagatcacagagggaattctggctgacgagtgcgctgccctgctgtgctacttctttagaatgcccagacaggtgttcaacgcccagaaaaaagctcagagcagcaccgattccggcggaagcagcggaggatcttctggaagcgaaaccccaggcaccagcgagtctgccacaccagaatcatctggcggtagctccggcggcagcgacaagaagtattctatcggactggccatcggcaccaactctgttggatgggccgtgatcaccgacgagtacaaggtgcccagcaagaaattcaaggtgctgggcaacaccgacaggcacagcatcaagaagaacctgatcggcgcactgctgttcgactctggcgaaacagccgaggccaccagactgaagagaacagcccgcagacggtacaccagaagaaagaaccggatctgctacctccaagagatcttcagcaacgagatggccaaggtggacgacagcttcttccacagactggaagagtccttcctggtggaagaggacaagaagcacgagagacaccccatcttcggcaacatcgtggacgaggtggcctaccacgagaagtaccccaccatctaccacctgagaaagaaactggtggacagcaccgacaaggccgacctgagactgatctatctggccctggctcacatgatcaagttccggggccacttcctgatcgagggcgacctgaatcctgacaacagcgacgtggacaagctgttcatccagctggtgcagacctacaaccagctgttcgaggaaaaccccatcaacgccagcggagtggatgccaaggccatcctgtctgccagactgagcaagagcagacggctggaaaatctgatcgcccagctgcctggcgagaagaagaatggcctgttcggcaacctgattgccctgagcctgggcctgacacctaacttcaagagcaacttcgacctggccgaggacgccaaactgcagctgagcaaggacacctacgacgacgacctggacaatctgctggcccagatcggcgatcagtacgccgacttgtttctggccgccaagaatctgagcgacgccatcctgctgtccgacatcctgagagtgaacaccgagatcaccaaggcacctctgagcgcctctatgatcaagagatacgacgagcaccaccaggatctgaccctgctgaaggccctcgttagacagcagctgccagagaagtacaaagagattttcttcgaccagagcaagaacggctacgccggctacattgatggcggagccagccaagaggaattctacaagttcatcaagcccatcctcgagaagatggacggcaccgaggaactgctggtcaagctgaacagagaggacctgctgagaaagcagagaaccttcgacaacggcagcatccctcaccagatccacctgggagaactgcacgccattctgcggagacaagaggacttttacccattcctgaaggacaaccgggaaaagatcgagaaaatcctgaccttcaggatcccctactacgtgggaccactggccagaggcaatagcagattcgcctggatgaccagaaagagcgaggaaaccatctgcctgagctacgataccgagatcctgaccgtggaatacggcttcctgcctatcggcaagatcgtcgaggaacggatcgagtgcacagtgtacaccgtggataagaatggcttcgtgtacacccagcctatcgctcagtggcacaacagaggcgagcaagaggtgttcgagtactgcctggaagatggcagcatcatccgggccaccaaggaccacaagtttatgaccaccgacggccagatgctgcccatcgacgagatctttgagagaggcctggacctgaaacaggtggacggactgccttga

SEQ ID NO: 140 - DNA, 3213 bp, Artificial Sequence
  Description of Artificial Sequence: Synthetic polynucleotide
atgagcgaggtggaattcagccacgagtactggatgcggcacgccctgacactggccaaaagagcttgggacgagagggaagtgcctgtgggagctgtgctggtgcacaacaacagagtgatcggcgaaggctggaacagacccatcggcagacacgatcctacagctcacgccgagatcatggccctgagacaaggcggactggtcatgcagaactaccggctgatcgacgccacactgtacgtgaccctggaaccttgcgtgatgtgtgccggcgctatgatccacagcagaatcggcagagtggtgttcggcgccagagatgccaaaacaggcgctgccggaagcctgatggatgtgctgcatcaccccggcatgaaccacagagtggaaatcaccgagggcatcctggccgatgaatgtgccgctctgctgagcgacttcttccggatgcggcggcaagagatcaaggcccagaagaaggcccagtccagcacagatagcggcggatctagcggaggcagctctggatctgagacacctggcacaagcgagagcgccacacctgaaagttctggcggttcttctggcggcagcagcgaggtcgagttctctcacgaatattggatgagacacgctctcaccctggctaagagagccagggacgaaagagaggtgccagttggcgctgtcctggtgttgaacaatcgcgtcatcggagaaggatggaatcgcgccattggcctgcacgatccaaccgcacatgccgaaattatggctctgcggcaaggcggcctcgtgatgcaaaattacagactgatcgatgctaccctctacgtcaccttcgagccctgtgtcatgtgtgctggggcaatgattcactcccggattggccgcgtggtgtttggagtgcggaatgccaagactggcgccgctggatctctgatggacgtcctgcactatcctgggatgaaccaccgggtcgagatcacagagggaattctggctgacgagtgcgctgccctgctgtgctacttctttagaatgcccagacaggtgttcaacgcccagaaaaaagctcagagcagcaccgattccggcggaagcagcggaggatcttctggaagcgaaaccccaggcaccagcgagtctgccacaccagaatcatctggcggtagctccggcggcagcgacaagaagtattctatcggactggccatcggcaccaactctgttggatgggccgtgatcaccgacgagtacaaggtgcccagcaagaaattcaaggtgctgggcaacaccgacaggcacagcatcaagaagaacctgatcggcgcactgctgttcgactctggcgaaacagccgaggccaccagactgaagagaacagcccgcagacggtacaccagaagaaagaaccggatctgctacctccaagagatcttcagcaacgagatggccaaggtggacgacagcttcttccacagactggaagagtccttcctggtggaagaggacaagaagcacgagagacaccccatcttcggcaacatcgtggacgaggtggcctaccacgagaagtaccccaccatctaccacctgagaaagaaactggtggacagcaccgacaaggccgacctgagactgatctatctggccctggctcacatgatcaagttccggggccacttcctgatcgagggcgacctgaatcctgacaacagcgacgtggacaagctgttcatccagctggtgcagacctacaaccagctgttcgaggaaaaccccatcaacgccagcggagtggatgccaaggccatcctgtctgccagactgagcaagagcagacggctggaaaatctgatcgcccagctgcctggcgagaagaagaatggcctgttcggcaacctgattgccctgagcctgggcctgacacctaacttcaagagcaacttcgacctggccgaggacgccaaactgcagctgagcaaggacacctacgacgacgacctggacaatctgctggcccagatcggcgatcagtacgccgacttgtttctggccgccaagaatctgagcgacgccatcctgctgtccgacatcctgagagtgaacaccgagatcaccaaggcacctctgagcgcctctatgatcaagagatacgacgagcaccaccaggatctgaccctgctgaaggccctcgttagacagcagctgccagagaagtacaaagagattttcttcgaccagagcaagaacggctacgccggctacattgatggcggagccagccaagaggaattctacaagttcatcaagcccatcctcgagaagatggacggcaccgaggaactgctggtcaagctgaacagagaggacctgctgagaaagcagagaaccttcgacaacggcagcatccctcaccagatccacctgggagaactgcacgccattctgcggagacaagaggacttttacccattcctgaaggacaaccgggaaaagatcgagaaaatcctgaccttcaggatcccctactacgtgggaccactggccagaggcaatagcagattcgcctggatgaccagaaagagcgaggaaaccatcactccctggaacttcgaggaagtggtggacaagggcgccagcgctcagtccttcatcgagcggatgaccaacttcgataagaacctgcctaacgagaaggtgctgcccaagcacagcctgctgtacgagtacttcaccgtgtacaacgagctgaccaaagtgaaatacgtgaccgagggaatgagaaagcccgcctttctgagcggcgagcagaaaaaggccatcgtggatctgctgttcaagaccaaccggaaagtgaccgtgaagcagctgaaagaggactacttcaagaaaatcgagtgcctgagctacgataccgagatcctgaccgtggaatacggcttcctgcctatcggcaagatcgtcgaggaacggatcgagtgcacagtgtacaccgtggataagaatggcttcgtgtacacccagcctatcgctcagtggcacaacagaggcgagcaagaggtgttcgagtactgcctggaagatggcagcatcatccgggccaccaaggaccacaagtttatgaccaccgacggccagatgctgcccatcgacgagatctttgagagaggcctggacctgaaacaggtggacggactgccttga

SEQ ID NO: 141 - DNA, 3222 bp, Artificial Sequence
  Description of Artificial Sequence: Synthetic polynucleotide
atgagcgaggtggaattcagccacgagtactggatgcggcacgccctgacactggccaaaagagcttgggacgagagggaagtgcctgtgggagctgtgctggtgcacaacaacagagtgatcggcgaaggctggaacagacccatcggcagacacgatcctacagctcacgccgagatcatggccctgagacaaggcggactggtcatgcagaactaccggctgatcgacgccacactgtacgtgaccctggaaccttgcgtgatgtgtgccggcgctatgatccacagcagaatcggcagagtggtgttcggcgccagagatgccaaaacaggcgctgccggaagcctgatggatgtgctgcatcaccccggcatgaaccacagagtggaaatcaccgagggcatcctggccgatgaatgtgccgctctgctgagcgacttcttccggatgcggcggcaagagatcaaggcccagaagaaggcccagtccagcacagatagcggcggatctagcggaggcagctctggatctgagacacctggcacaagcgagagcgccacacctgaaagttctggcggttcttctggcggcagcagcgaggtcgagttctctcacgaatattggatgagacacgctctcaccctggctaagagagccagggacgaaagagaggtgccagttggcgctgtcctggtgttgaacaatcgcgtcatcggagaaggatggaatcgcgccattggcctgcacgatccaaccgcacatgccgaaattatggctctgcggcaaggcggcctcgtgatgcaaaattacagactgatcgatgctaccctctacgtcaccttcgagccctgtgtcatgtgtgctggggcaatgattcactcccggattggccgcgtggtgtttggagtgcggaatgccaagactggcgccgctggatctctgatggacgtcctgcactatcctgggatgaaccaccgggtcgagatcacagagggaattctggctgacgagtgcgctgccctgctgtgctacttctttagaatgcccagacaggtgttcaacgcccagaaaaaagctcagagcagcaccgattccggcggaagcagcggaggatcttctggaagcgaaaccccaggcaccagcgagtctgccacaccagaatcatctggcggtagctccggcggcagcgacaagaagtattctatcggactggccatcggcaccaactctgttggatgggccgtgatcaccgacgagtacaaggtgcccagcaagaaattcaaggtgctgggcaacaccgacaggcacagcatcaagaagaacctgatcggcgcactgctgttcgactctggcgaaacagccgaggccaccagactgaagagaacagcccgcagacggtacaccagaagaaagaaccggatctgctacctccaagagatcttcagcaacgagatggccaaggtggacgacagcttcttccacagactggaagagtccttcctggtggaagaggacaagaagcacgagagacaccccatcttcggcaacatcgtggacgaggtggcctaccacgagaagtaccccaccatctaccacctgagaaagaaactggtggacagcaccgacaaggccgacctgagactgatctatctggccctggctcacatgatcaagttccggggccacttcctgatcgagggcgacctgaatcctgacaacagcgacgtggacaagctgttcatccagctggtgcagacctacaaccagctgttcgaggaaaaccccatcaacgccagcggagtggatgccaaggccatcctgtctgccagactgagcaagagcagacggctggaaaatctgatcgcccagctgcctggcgagaagaagaatggcctgttcggcaacctgattgccctgagcctgggcctgacacctaacttcaagagcaacttcgacctggccgaggacgccaaactgcagctgagcaaggacacctacgacgacgacctggacaatctgctggcccagatcggcgatcagtacgccgacttgtttctggccgccaagaatctgagcgacgccatcctgctgtccgacatcctgagagtgaacaccgagatcaccaaggcacctctgagcgcctctatgatcaagagatacgacgagcaccaccaggatctgaccctgctgaaggccctcgttagacagcagctgccagagaagtacaaagagattttcttcgaccagagcaagaacggctacgccggctacattgatggcggagccagccaagaggaattctacaagttcatcaagcccatcctcgagaagatggacggcaccgaggaactgctggtcaagctgaacagagaggacctgctgagaaagcagagaaccttcgacaacggcagcatccctcaccagatccacctgggagaactgcacgccattctgcggagacaagaggacttttacccattcctgaaggacaaccgggaaaagatcgagaaaatcctgaccttcaggatcccctactacgtgggaccactggccagaggcaatagcagattcgcctggatgaccagaaagagcgaggaaaccatcactccctggaacttcgaggaagtggtggacaagggcgccagcgctcagtccttcatcgagcggatgaccaacttcgataagaacctgcctaacgagaaggtgctgcccaagcacagcctgctgtacgagtacttcaccgtgtacaacgagctgaccaaagtgaaatacgtgaccgagggaatgagaaagcccgcctttctgagcggcgagcagaaaaaggccatcgtggatctgctgttcaagaccaaccggaaagtgaccgtgaagcagctgaaagaggactacttcaagaaaatcgagtgcttcgactgcctgagctacgataccgagatcctgaccgtggaatacggcttcctgcctatcggcaagatcgtcgaggaacggatcgagtgcacagtgtacaccgtggataagaatggcttcgtgtacacccagcctatcgctcagtggcacaacagaggcgagcaagaggtgttcgagtactgcctggaagatggcagcatcatccgggccaccaaggaccacaagtttatgaccaccgacggccagatgctgcccatcgacgagatctttgagagaggcctggacctgaaacaggtggacggactgccttga

SEQ ID NO: 142 - DNA, 3258 bp, Artificial Sequence
  Description of Artificial Sequence: Synthetic polynucleotide
atgagcgaggtggaattcagccacgagtactggatgcggcacgccctgacactggccaaaagagcttgggacgagagggaagtgcctgtgggagctgtgctggtgcacaacaacagagtgatcggcgaaggctggaacagacccatcggcagacacgatcctacagctcacgccgagatcatggccctgagacaaggcggactggtcatgcagaactaccggctgatcgacgccacactgtacgtgaccctggaaccttgcgtgatgtgtgccggcgctatgatccacagcagaatcggcagagtggtgttcggcgccagagatgccaaaacaggcgctgccggaagcctgatggatgtgctgcatcaccccggcatgaaccacagagtggaaatcaccgagggcatcctggccgatgaatgtgccgctctgctgagcgacttcttccggatgcggcggcaagagatcaaggcccagaagaaggcccagtccagcacagatagcggcggatctagcggaggcagctctggatctgagacacctggcacaagcgagagcgccacacctgaaagttctggcggttcttctggcggcagcagcgaggtcgagttctctcacgaatattggatgagacacgctctcaccctggctaagagagccagggacgaaagagaggtgccagttggcgctgtcctggtgttgaacaatcgcgtcatcggagaaggatggaatcgcgccattggcctgcacgatccaaccgcacatgccgaaattatggctctgcggcaaggcggcctcgtgatgcaaaattacagactgatcgatgctaccctctacgtcaccttcgagccctgtgtcatgtgtgctggggcaatgattcactcccggattggccgcgtggtgtttggagtgcggaatgccaagactggcgccgctggatctctgatggacgtcctgcactatcctgggatgaaccaccgggtcgagatcacagagggaattctggctgacgagtgcgctgccctgctgtgctacttctttagaatgcccagacaggtgttcaacgcccagaaaaaagctcagagcagcaccgattccggcggaagcagcggaggatcttctggaagcgaaaccccaggcaccagcgagtctgccacaccagaatcatctggcggtagctccggcggcagcgacaagaagtattctatcggactggccatcggcaccaactctgttggatgggccgtgatcaccgacgagtacaaggtgcccagcaagaaattcaaggtgctgggcaacaccgacaggcacagcatcaagaagaacctgatcggcgcactgctgttcgactctggcgaaacagccgaggccaccagactgaagagaacagcccgcagacggtacaccagaagaaagaaccggatctgctacctccaagagatcttcagcaacgagatggccaaggtggacgacagcttcttccacagactggaagagtccttcctggtggaagaggacaagaagcacgagagacaccccatcttcggcaacatcgtggacgaggtggcctaccacgagaagtaccccaccatctaccacctgagaaagaaactggtggacagcaccgacaaggccgacctgagactgatctatctggccctggctcacatgatcaagttccggggccacttcctgatcgagggcgacctgaatcctgacaacagcgacgtggacaagctgttcatccagctggtgcagacctacaaccagctgttcgaggaaaaccccatcaacgccagcggagtggatgccaaggccatcctgtctgccagactgagcaagagcagacggctggaaaatctgatcgcccagctgcctggcgagaagaagaatggcctgttcggcaacctgattgccctgagcctgggcctgacacctaacttcaagagcaacttcgacctggccgaggacgccaaactgcagctgagcaaggacacctacgacgacgacctggacaatctgctggcccagatcggcgatcagtacgccgacttgtttctggccgccaagaatctgagcgacgccatcctgctgtccgacatcctgagagtgaacaccgagatcaccaaggcacctctgagcgcctctatgatcaagagatacgacgagcaccaccaggatctgaccctgctgaaggccctcgttagacagcagctgccagagaagtacaaagagattttcttcgaccagagcaagaacggctacgccggctacattgatggcggagccagccaagaggaattctacaagttcatcaagcccatcctcgagaagatggacggcaccgaggaactgctggtcaagctgaacagagaggacctgctgagaaagcagagaaccttcgacaacggcagcatccctcaccagatccacctgggagaactgcacgccattctgcggagacaagaggacttttacccattcctgaaggacaaccgggaaaagatcgagaaaatcctgaccttcaggatcccctactacgtgggaccactggccagaggcaatagcagattcgcctggatgaccagaaagagcgaggaaaccatcactccctggaacttcgaggaagtggtggacaagggcgccagcgctcagtccttcatcgagcggatgaccaacttcgataagaacctgcctaacgagaaggtgctgcccaagcacagcctgctgtacgagtacttcaccgtgtacaacgagctgaccaaagtgaaatacgtgaccgagggaatgagaaagcccgcctttctgagcggcgagcagaaaaaggccatcgtggatctgctgttcaagaccaaccggaaagtgaccgtgaagcagctgaaagaggactacttcaagaaaatcgagtgcttcgacagcgtcgagatctccggcgtggaagatcggttcaattgcctgagctacgataccgagatcctgaccgtggaatacggcttcctgcctatcggcaagatcgtcgaggaacggatcgagtgcacagtgtacaccgtggataagaatggcttcgtgtacacccagcctatcgctcagtggcacaacagaggcgagcaagaggtgttcgagtactgcctggaagatggcagcatcatccgggccaccaaggaccacaagtttatgaccaccgacggccagatgctgcccatcgacgagatctttgagagaggcctggacctgaaacaggtggacggactgccttga

SEQ ID NO: 143 - DNA, 3261 bp, Artificial Sequence
  Description of Artificial Sequence: Synthetic polynucleotide
atgagcgaggtggaattcagccacgagtactggatgcggcacgccctgacactggccaaaagagcttgggacgagagggaagtgcctgtgggagctgtgctggtgcacaacaacagagtgatcggcgaaggctggaacagacccatcggcagacacgatcctacagctcacgccgagatcatggccctgagacaaggcggactggtcatgcagaactaccggctgatcgacgccacactgtacgtgaccctggaaccttgcgtgatgtgtgccggcgctatgatccacagcagaatcggcagagtggtgttcggcgccagagatgccaaaacaggcgctgccggaagcctgatggatgtgctgcatcaccccggcatgaaccacagagtggaaatcaccgagggcatcctggccgatgaatgtgccgctctgctgagcgacttcttccggatgcggcggcaagagatcaaggcccagaagaaggcccagtccagcacagatagcggcggatctagcggaggcagctctggatctgagacacctggcacaagcgagagcgccacacctgaaagttctggcggttcttctggcggcagcagcgaggtcgagttctctcacgaatattggatgagacacgctctcaccctggctaagagagccagggacgaaagagaggtgccagttggcgctgtcctggtgttgaacaatcgcgtcatcggagaaggatggaatcgcgccattggcctgcacgatccaaccgcacatgccgaaattatggctctgcggcaaggcggcctcgtgatgcaaaattacagactgatcgatgctaccctctacgtcaccttcgagccctgtgtcatgtgtgctggggcaatgattcactcccggattggccgcgtggtgtttggagtgcggaatgccaagactggcgccgctggatctctgatggacgtcctgcactatcctgggatgaaccaccgggtcgagatcacagagggaattctggctgacgagtgcgctgccctgctgtgctacttctttagaatgcccagacaggtgttcaacgcccagaaaaaagctcagagcagcaccgattccggcggaagcagcggaggatcttctggaagcgaaaccccaggcaccagcgagtctgccacaccagaatcatctggcggtagctccggcggcagcgacaagaagtattctatcggactggccatcggcaccaactctgttggatgggccgtgatcaccgacgagtacaaggtgcccagcaagaaattcaaggtgctgggcaacaccgacaggcacagcatcaagaagaacctgatcggcgcactgctgttcgactctggcgaaacagccgaggccaccagactgaagagaacagcccgcagacggtacaccagaagaaagaaccggatctgctacctccaagagatcttcagcaacgagatggccaaggtggacgacagcttcttccacagactggaagagtccttcctggtggaagaggacaagaagcacgagagacaccccatcttcggcaacatcgtggacgaggtggcctaccacgagaagtaccccaccatctaccacctgagaaagaaactggtggacagcaccgacaaggccgacctgagactgatctatctggccctggctcacatgatcaagttccggggccacttcctgatcgagggcgacctgaatcctgacaacagcgacgtggacaagctgttcatccagctggtgcagacctacaaccagctgttcgaggaaaaccccatcaacgccagcggagtggatgccaaggccatcctgtctgccagactgagcaagagcagacggctggaaaatctgatcgcccagctgcctggcgagaagaagaatggcctgttcggcaacctgattgccctgagcctgggcctgacacctaacttcaagagcaacttcgacctggccgaggacgccaaactgcagctgagcaaggacacctacgacgacgacctggacaatctgctggcccagatcggcgatcagtacgccgacttgtttctggccgccaagaatctgagcgacgccatcctgctgtccgacatcctgagagtgaacaccgagatcaccaaggcacctctgagcgcctctatgatcaagagatacgacgagcaccaccaggatctgaccctgctgaaggccctcgttagacagcagctgccagagaagtacaaagagattttcttcgaccagagcaagaacggctacgccggctacattgatggcggagccagccaagaggaattctacaagttcatcaagcccatcctcgagaagatggacggcaccgaggaactgctggtcaagctgaacagagaggacctgctgagaaagcagagaaccttcgacaacggcagcatccctcaccagatccacctgggagaactgcacgccattctgcggagacaagaggacttttacccattcctgaaggacaaccgggaaaagatcgagaaaatcctgaccttcaggatcccctactacgtgggaccactggccagaggcaatagcagattcgcctggatgaccagaaagagcgaggaaaccatcactccctggaacttcgaggaagtggtggacaagggcgccagcgctcagtccttcatcgagcggatgaccaacttcgataagaacctgcctaacgagaaggtgctgcccaagcacagcctgctgtacgagtacttcaccgtgtacaacgagctgaccaaagtgaaatacgtgaccgagggaatgagaaagcccgcctttctgagcggcgagcagaaaaaggccatcgtggatctgctgttcaagaccaaccggaaagtgaccgtgaagcagctgaaagaggactacttcaagaaaatcgagtgcttcgacagcgtcgagatctccggcgtggaagatcggttcaatgcctgcctgagctacgataccgagatcctgaccgtggaatacggcttcctgcctatcggcaagatcgtcgaggaacggatcgagtgcacagtgtacaccgtggataagaatggcttcgtgtacacccagcctatcgctcagtggcacaacagaggcgagcaagaggtgttcgagtactgcctggaagatggcagcatcatccgggccaccaaggaccacaagtttatgaccaccgacggccagatgctgcccatcgacgagatctttgagagaggcctggacctgaaacaggtggacggactgccttga

SEQ ID NO: 144 - DNA, 1494 bp, Artificial Sequence
  Description of Artificial Sequence: Synthetic polynucleotide
atgagcgaggtggaattcagccacgagtactggatgcggcacgccctgacactggccaaaagagcttgggacgagagggaagtgcctgtgggagctgtgctggtgcacaacaacagagtgatcggcgaaggctggaacagacccatcggcagacacgatcctacagctcacgccgagatcatggccctgagacaaggcggactggtcatgcagaactaccggctgatcgacgccacactgtacgtgaccctggaaccttgcgtgatgtgtgccggcgctatgatccacagcagaatcggcagagtggtgttcggcgccagagatgccaaaacaggcgctgccggaagcctgatggatgtgctgcatcaccccggcatgaaccacagagtggaaatcaccgagggcatcctggccgatgaatgtgccgctctgctgagcgacttcttccggatgcggcggcaagagatcaaggcccagaagaaggcccagtccagcacagatagcggcggatctagcggaggcagctctggatctgagacacctggcacaagcgagagcgccacacctgaaagttctggcggttcttctggcggcagcagcgaggtcgagttctctcacgaatattggatgagacacgctctcaccctggctaagagagccagggacgaaagagaggtgccagttggcgctgtcctggtgttgaacaatcgcgtcatcggagaaggatggaatcgcgccattggcctgcacgatccaaccgcacatgccgaaattatggctctgcggcaaggcggcctcgtgatgcaaaattacagactgatcgatgctaccctctacgtcaccttcgagccctgtgtcatgtgtgctggggcaatgattcactcccggattggccgcgtggtgtttggagtgcggaatgccaagactggcgccgctggatctctgatggacgtcctgcactatcctgggatgaaccaccgggtcgagatcacagagggaattctggctgacgagtgcgctgccctgctgtgctacttctttagaatgcccagacaggtgttcaacgcccagaaaaaagctcagagcagcaccgattccggcggaagcagcggaggatcttctggaagcgaaaccccaggcaccagcgagtctgccacaccagaatcatctggcggtagctccggcggctgcctgagctacgataccgagatcctgaccgtggaatacggcttcctgcctatcggcaagatcgtcgaggaacggatcgagtgcacagtgtacaccgtggataagaatggcttcgtgtacacccagcctatcgctcagtggcacaacagaggcgagcaagaggtgttcgagtactgcctggaagatggcagcatcatccgggccaccaaggaccacaagtttatgaccaccgacggccagatgctgcccatcgacgagatctttgagagaggcctggacctgaaacaggtggacggactgccttga

SEQ ID NO: 145 - DNA, 1401 bp, Artificial Sequence
  Description of Artificial Sequence: Synthetic polynucleotide
atgagcgaggtggaattcagccacgagtactggatgcggcacgccctgacactggccaaaagagcttgggacgagagggaagtgcctgtgggagctgtgctggtgcacaacaacagagtgatcggcgaaggctggaacagacccatcggcagacacgatcctacagctcacgccgagatcatggccctgagacaaggcggactggtcatgcagaactaccggctgatcgacgccacactgtacgtgaccctggaaccttgcgtgatgtgtgccggcgctatgatccacagcagaatcggcagagtggtgttcggcgccagagatgccaaaacaggcgctgccggaagcctgatggatgtgctgcatcaccccggcatgaaccacagagtggaaatcaccgagggcatcctggccgatgaatgtgccgctctgctgagcgacttcttccggatgcggcggcaagagatcaaggcccagaagaaggcccagtccagcacagatagcggcggatctagcggaggcagctctggatctgagacacctggcacaagcgagagcgccacacctgaaagttctggcggttcttctggcggcagcagcgaggtcgagttctctcacgaatattggatgagacacgctctcaccctggctaagagagccagggacgaaagagaggtgccagttggcgctgtcctggtgttgaacaatcgcgtcatcggagaaggatggaatcgcgccattggcctgcacgatccaaccgcacatgccgaaattatggctctgcggcaaggcggcctcgtgatgcaaaattacagactgatcgatgctaccctctacgtcaccttcgagccctgtgtcatgtgtgctggggcaatgattcactcccggattggccgcgtggtgtttggagtgcggaatgccaagactggcgccgctggatctctgatggacgtcctgcactatcctgggatgaaccaccgggtcgagatcacagagggaattctggctgacgagtgcgctgccctgctgtgctacttctttagaatgcccagacaggtgttcaacgcccagaaaaaagctcagagcagcaccgattgcctgagctacgataccgagatcctgaccgtggaatacggcttcctgcctatcggcaagatcgtcgaggaacggatcgagtgcacagtgtacaccgtggataagaatggcttcgtgtacacccagcctatcgctcagtggcacaacagaggcgagcaagaggtgttcgagtactgcctggaagatggcagcatcatccgggccaccaaggaccacaagtttatgaccaccgacggccagatgctgcccatcgacgagatctttgagagaggcctggacctgaaacaggtggacggactgccttga

SEQ ID NO: 146 - DNA, 3375 bp, Artificial Sequence
  Description of Artificial Sequence: Synthetic polynucleotide
atggtcaagatcatcagcagaaagagcctgggcacccagaacgtgtacgatatcggagtgggcgagccccacaactttctgctcaagaatggcctggtggccagcaactgcgacatcctgagagtgaacaccgagatcaccaaggcacctctgagcgcctctatgatcaagagatacgacgagcaccaccaggatctgaccctgctgaaggccctcgttagacagcagctgccagagaagtacaaagagattttcttcgaccagagcaagaacggctacgccggctacattgatggcggagccagccaagaggaattctacaagttcatcaagcccatcctcgagaagatggacggcaccgaggaactgctggtcaagctgaacagagaggacctgctgagaaagcagagaaccttcgacaacggcagcatccctcaccagatccacctgggagaactgcacgccattctgcggagacaagaggacttttacccattcctgaaggacaaccgggaaaagatcgagaaaatcctgaccttcaggatcccctactacgtgggaccactggccagaggcaatagcagattcgcctggatgaccagaaagagcgaggaaaccatcactccctggaacttcgaggaagtggtggacaagggcgccagcgctcagtccttcatcgagcggatgaccaacttcgataagaacctgcctaacgagaaggtgctgcccaagcacagcctgctgtacgagtacttcaccgtgtacaacgagctgaccaaagtgaaatacgtgaccgagggaatgagaaagcccgcctttctgagcggcgagcagaaaaaggccatcgtggatctgctgttcaagaccaaccggaaagtgaccgtgaagcagctgaaagaggactacttcaagaaaatcgagtgcttcgacagcgtcgagatctccggcgtggaagatcggttcaatgccagcctgggcacataccacgatctgctgaaaattatcaaggacaaggacttcctggacaacgaagagaacgaggacatccttgaggacatcgtgctgacactgaccctgtttgaggacagagagatgatcgaggaacggctgaaaacatacgcccacctgttcgacgacaaagtgatgaagcaactgaagcggcggagatacaccggctggggcagactgtctcggaagctgatcaacggcatccgggataagcagtccggcaagaccatcctggactttctgaagtccgacggcttcgccaacagaaacttcatgcagctgattcacgacgacagcctcaccttcaaagaggatatccagaaagcccaggtgtccggccagggcgattctctgcatgagcacattgccaacctggccggctctcccgccattaagaaaggcatcctgcagacagtgaaggtggtggacgagcttgtgaaagtgatgggcagacacaagcccgagaacatcgtgatcgaaatggccagagagaaccagaccacacagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatggacgggatatgtacgtggaccaagagctggacatcaacagactgtccgactacgatgtggaccatatcgtgccccagtcttttctgaaggacgactccatcgacaacaaggtcctgaccagatccgacaagaatcggggcaagagcgacaacgtgccctccgaagaggtggtcaagaagatgaagaactactggcgacagctgctgaacgccaagctgattacccagcggaagttcgacaatctgaccaaggccgaaagaggcggcctgagcgaactggataaggccggcttcatcaagagacagctggtggaaacccggcagatcacaaagcacgtggcacagattctggactctcggatgaacactaagtacgacgagaacgacaaactgatccgcgaagtgaaagtcatcaccctgaagtccaagctggtgtccgatttccggaaggatttccagttctacaaagtgcgcgagatcaacaactaccatcacgcccacgacgcctacctgaatgccgttgttggaacagccctgatcaaaaagtaccctaagctggaaagcgagttcgtgtacggcgactacaaggtgtacgacgtgcggaagatgatcgccaagagcgagcaagagattggcaaggcaaccgccaagtacttcttctacagcaacatcatgaactttttcaagacagagatcaccctcgccaacggcgagatcagaaagcggcctctgatcgagacaaacggcgaaaccggcgagattgtgtgggataagggcagagactttgccacagtgcggaaagtgctgagcatgccccaagtgaatatcgtgaagaaaaccgaggtgcagacaggcggcttcagcaaagagtctatcctgcctaagcggaactccgacaagctgatcgccagaaagaaggactgggaccccaagaagtacggcggcttcgattctcctaccgtggcctatagcgtgctggtggtggccaaagtggaaaagggcaagtccaagaaactcaagagcgtgaaagagctgctggggatcaccatcatggaaagaagcagcttcgagaagaatccgatcgatttcctcgaggccaagggctacaaagaagtgaaaaaggacctgatcatcaagctccccaagtactccctgttcgagctggaaaacggccggaagagaatgctggcctctgctggcgaactgcagaagggaaacgaactggccctgcctagcaaatatgtgaacttcctgtacctggccagccactatgagaagctgaagggcagccccgaggacaatgagcaaaagcagctgtttgtggaacagcacaagcactacctggacgagatcatcgagcagatcagcgagtttagcaagagagtgattctggccgacgccaatctggacaaagtgctgtccgcctacaacaagcaccgggacaagcctatcagagagcaggccgagaatatcatccacctgtttaccctgaccaacctgggagcccctgccgccttcaagtactttgacaccaccatcgaccggaagcggtacacctccaccaaagaggtgctggacgccactctgatccaccagtctatcaccggcctgtacgagacacggatcgacctgtctcaactcggaggcgacgaaggcgccgataagagaaccgccgatggctctgagttcgagagccccaagaaaaagcgcaaagtgtga

SEQ ID NO: 147 - DNA, 3354 bp, Artificial Sequence
  Description of Artificial Sequence: Synthetic polynucleotide
atggtcaagatcatcagcagaaagagcctgggcacccagaacgtgtacgatatcggagtgggcgagccccacaactttctgctcaagaatggcctggtggccagcaactgcgagatcaccaaggcacctctgagcgcctctatgatcaagagatacgacgagcaccaccaggatctgaccctgctgaaggccctcgttagacagcagctgccagagaagtacaaagagattttcttcgaccagagcaagaacggctacgccggctacattgatggcggagccagccaagaggaattctacaagttcatcaagcccatcctcgagaagatggacggcaccgaggaactgctggtcaagctgaacagagaggacctgctgagaaagcagagaaccttcgacaacggcagcatccctcaccagatccacctgggagaactgcacgccattctgcggagacaagaggacttttacccattcctgaaggacaaccgggaaaagatcgagaaaatcctgaccttcaggatcccctactacgtgggaccactggccagaggcaatagcagattcgcctggatgaccagaaagagcgaggaaaccatcactccctggaacttcgaggaagtggtggacaagggcgccagcgctcagtccttcatcgagcggatgaccaacttcgataagaacctgcctaacgagaaggtgctgcccaagcacagcctgctgtacgagtacttcaccgtgtacaacgagctgaccaaagtgaaatacgtgaccgagggaatgagaaagcccgcctttctgagcggcgagcagaaaaaggccatcgtggatctgctgttcaagaccaaccggaaagtgaccgtgaagcagctgaaagaggactacttcaagaaaatcgagtgcttcgacagcgtcgagatctccggcgtggaagatcggttcaatgccagcctgggcacataccacgatctgctgaaaattatcaaggacaaggacttcctggacaacgaagagaacgaggacatccttgaggacatcgtgctgacactgaccctgtttgaggacagagagatgatcgaggaacggctgaaaacatacgcccacctgttcgacgacaaagtgatgaagcaactgaagcggcggagatacaccggctggggcagactgtctcggaagctgatcaacggcatccgggataagcagtccggcaagaccatcctggactttctgaagtccgacggcttcgccaacagaaacttcatgcagctgattcacgacgacagcctcaccttcaaagaggatatccagaaagcccaggtgtccggccagggcgattctctgcatgagcacattgccaacctggccggctctcccgccattaagaaaggcatcctgcagacagtgaaggtggtggacgagcttgtgaaagtgatgggcagacacaagcccgagaacatcgtgatcgaaatggccagagagaaccagaccacacagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatggacgggatatgtacgtggaccaagagctggacatcaacagactgtccgactacgatgtggaccatatcgtgccccagtcttttctgaaggacgactccatcgacaacaaggtcctgaccagatccgacaagaatcggggcaagagcgacaacgtgccctccgaagaggtggtcaagaagatgaagaactactggcgacagctgctgaacgccaagctgattacccagcggaagttcgacaatctgaccaaggccgaaagaggcggcctgagcgaactggataaggccggcttcatcaagagacagctggtggaaacccggcagatcacaaagcacgtggcacagattctggactctcggatgaacactaagtacgacgagaacgacaaactgatccgcgaagtgaaagtcatcaccctgaagtccaagctggtgtccgatttccggaaggatttccagttctacaaagtgcgcgagatcaacaactaccatcacgcccacgacgcctacctgaatgccgttgttggaacagccctgatcaaaaagtaccctaagctggaaagcgagttcgtgtacggcgactacaaggtgtacgacgtgcggaagatgatcgccaagagcgagcaagagattggcaaggcaaccgccaagtacttcttctacagcaacatcatgaactttttcaagacagagatcaccctcgccaacggcgagatcagaaagcggcctctgatcgagacaaacggcgaaaccggcgagattgtgtgggataagggcagagactttgccacagtgcggaaagtgctgagcatgccccaagtgaatatcgtgaagaaaaccgaggtgcagacaggcggcttcagcaaagagtctatcctgcctaagcggaactccgacaagctgatcgccagaaagaaggactgggaccccaagaagtacggcggcttcgattctcctaccgtggcctatagcgtgctggtggtggccaaagtggaaaagggcaagtccaagaaactcaagagcgtgaaagagctgctggggatcaccatcatggaaagaagcagcttcgagaagaatccgatcgatttcctcgaggccaagggctacaaagaagtgaaaaaggacctgatcatcaagctccccaagtactccctgttcgagctggaaaacggccggaagagaatgctggcctctgctggcgaactgcagaagggaaacgaactggccctgcctagcaaatatgtgaacttcctgtacctggccagccactatgagaagctgaagggcagccccgaggacaatgagcaaaagcagctgtttgtggaacagcacaagcactacctggacgagatcatcgagcagatcagcgagtttagcaagagagtgattctggccgacgccaatctggacaaagtgctgtccgcctacaacaagcaccgggacaagcctatcagagagcaggccgagaatatcatccacctgtttaccctgaccaacctgggagcccctgccgccttcaagtactttgacaccaccatcgaccggaagcggtacacctccaccaaagaggtgctggacgccactctgatccaccagtctatcaccggcctgtacgagacacggatcgacctgtctcaactcggaggcgacgaaggcgccgataagagaaccgccgatggctctgagttcgagagccccaagaaaaagcgcaaagtgtga

SEQ ID NO: 148 - DNA, 3345 bp, Artificial Sequence
  Description of Artificial Sequence: Synthetic polynucleotide
atggtcaagatcatcagcagaaagagcctgggcacccagaacgtgtacgatatcggagtgggcgagccccacaactttctgctcaagaatggcctggtggccagcaactgcaaggcacctctgagcgcctctatgatcaagagatacgacgagcaccaccaggatctgaccctgctgaaggccctcgttagacagcagctgccagagaagtacaaagagattttcttcgaccagagcaagaacggctacgccggctacattgatggcggagccagccaagaggaattctacaagttcatcaagcccatcctcgagaagatggacggcaccgaggaactgctggtcaagctgaacagagaggacctgctgagaaagcagagaaccttcgacaacggcagcatccctcaccagatccacctgggagaactgcacgccattctgcggagacaagaggacttttacccattcctgaaggacaaccgggaaaagatcgagaaaatcctgaccttcaggatcccctactacgtgggaccactggccagaggcaatagcagattcgcctggatgaccagaaagagcgaggaaaccatcactccctggaacttcgaggaagtggtggacaagggcgccagcgctcagtccttcatcgagcggatgaccaacttcgataagaacctgcctaacgagaaggtgctgcccaagcacagcctgctgtacgagtacttcaccgtgtacaacgagctgaccaaagtgaaatacgtgaccgagggaatgagaaagcccgcctttctgagcggcgagcagaaaaaggccatcgtggatctgctgttcaagaccaaccggaaagtgaccgtgaagcagctgaaagaggactacttcaagaaaatcgagtgcttcgacagcgtcgagatctccggcgtggaagatcggttcaatgccagcctgggcacataccacgatctgctgaaaattatcaaggacaaggacttcctggacaacgaagagaacgaggacatccttgaggacatcgtgctgacactgaccctgtttgaggacagagagatgatcgaggaacggctgaaaacatacgcccacctgttcgacgacaaagtgatgaagcaactgaagcggcggagatacaccggctggggcagactgtctcggaagctgatcaacggcatccgggataagcagtccggcaagaccatcctggactttctgaagtccgacggcttcgccaacagaaacttcatgcagctgattcacgacgacagcctcaccttcaaagaggatatccagaaagcccaggtgtccggccagggcgattctctgcatgagcacattgccaacctggccggctctcccgccattaagaaaggcatcctgcagacagtgaaggtggtggacgagcttgtgaaagtgatgggcagacacaagcccgagaacatcgtgatcgaaatggccagagagaaccagaccacacagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatggacgggatatgtacgtggaccaagagctggacatcaacagactgtccgactacgatgtggaccatatcgtgccccagtcttttctgaaggacgactccatcgacaacaaggtcctgaccagatccgacaagaatcggggcaagagcgacaacgtgccctccgaagaggtggtcaagaagatgaagaactactggcgacagctgctgaacgccaagctgattacccagcggaagttcgacaatctgaccaaggccgaaagaggcggcctgagcgaactggataaggccggcttcatcaagagacagctggtggaaacccggcagatcacaaagcacgtggcacagattctggactctcggatgaacactaagtacgacgagaacgacaaactgatccgcgaagtgaaagtcatcaccctgaagtccaagctggtgtccgatttccggaaggatttccagttctacaaagtgcgcgagatcaacaactaccatcacgcccacgacgcctacctgaatgccgttgttggaacagccctgatcaaaaagtaccctaagctggaaagcgagttcgtgtacggcgactacaaggtgtacgacgtgcggaagatgatcgccaagagcgagcaagagattggcaaggcaaccgccaagtacttcttctacagcaacatcatgaactttttcaagacagagatcaccctcgccaacggcgagatcagaaagcggcctctgatcgagacaaacggcgaaaccggcgagattgtgtgggataagggcagagactttgccacagtgcggaaagtgctgagcatgccccaagtgaatatcgtgaagaaaaccgaggtgcagacaggcggcttcagcaaagagtctatcctgcctaagcggaactccgacaagctgatcgccagaaagaaggactgggaccccaagaagtacggcggcttcgattctcctaccgtggcctatagcgtgctggtggtggccaaagtggaaaagggcaagtccaagaaactcaagagcgtgaaagagctgctggggatcaccatcatggaaagaagcagcttcgagaagaatccgatcgatttcctcgaggccaagggctacaaagaagtgaaaaaggacctgatcatcaagctccccaagtactccctgttcgagctggaaaacggccggaagagaatgctggcctctgctggcgaactgcagaagggaaacgaactggccctgcctagcaaatatgtgaacttcctgtacctggccagccactatgagaagctgaagggcagccccgaggacaatgagcaaaagcagctgtttgtggaacagcacaagcactacctggacgagatcatcgagcagatcagcgagtttagcaagagagtgattctggccgacgccaatctggacaaagtgctgtccgcctacaacaagcaccgggacaagcctatcagagagcaggccgagaatatcatccacctgtttaccctgaccaacctgggagcccctgccgccttcaagtactttgacaccaccatcgaccggaagcggtacacctccaccaaagaggtgctggacgccactctgatccaccagtctatcaccggcctgtacgagacacggatcgacctgtctcaactcggaggcgacgaaggcgccgataagagaaccgccgatggctctgagttcgagagccccaagaaaaagcgcaaagtgtga

SEQ ID NO: 149 - DNA, 3219 bp, Artificial Sequence
  Description of Artificial Sequence: Synthetic polynucleotide
atggtcaagatcatcagcagaaagagcctgggcacccagaacgtgtacgatatcggagtgggcgagccccacaactttctgctcaagaatggcctggtggccagcaactgcaagaacggctacgccggctacattgatggcggagccagccaagaggaattctacaagttcatcaagcccatcctcgagaagatggacggcaccgaggaactgctggtcaagctgaacagagaggacctgctgagaaagcagagaaccttcgacaacggcagcatccctcaccagatccacctgggagaactgcacgccattctgcggagacaagaggacttttacccattcctgaaggacaaccgggaaaagatcgagaaaatcctgaccttcaggatcccctactacgtgggaccactggccagaggcaatagcagattcgcctggatgaccagaaagagcgaggaaaccatcactccctggaacttcgaggaagtggtggacaagggcgccagcgctcagtccttcatcgagcggatgaccaacttcgataagaacctgcctaacgagaaggtgctgcccaagcacagcctgctgtacgagtacttcaccgtgtacaacgagctgaccaaagtgaaatacgtgaccgagggaatgagaaagcccgcctttctgagcggcgagcagaaaaaggccatcgtggatctgctgttcaagaccaaccggaaagtgaccgtgaagcagctgaaagaggactacttcaagaaaatcgagtgcttcgacagcgtcgagatctccggcgtggaagatcggttcaatgccagcctgggcacataccacgatctgctgaaaattatcaaggacaaggacttcctggacaacgaagagaacgaggacatccttgaggacatcgtgctgacactgaccctgtttgaggacagagagatgatcgaggaacggctgaaaacatacgcccacctgttcgacgacaaagtgatgaagcaactgaagcggcggagatacaccggctggggcagactgtctcggaagctgatcaacggcatccgggataagcagtccggcaagaccatcctggactttctgaagtccgacggcttcgccaacagaaacttcatgcagctgattcacgacgacagcctcaccttcaaagaggatatccagaaagcccaggtgtccggccagggcgattctctgcatgagcacattgccaacctggccggctctcccgccattaagaaaggcatcctgcagacagtgaaggtggtggacgagcttgtgaaagtgatgggcagacacaagcccgagaacatcgtgatcgaaatggccagagagaaccagaccacacagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatggacgggatatgtacgtggaccaagagctggacatcaacagactgtccgactacgatgtggaccatatcgtgccccagtcttttctgaaggacgactccatcgacaacaaggtcctgaccagatccgacaagaatcggggcaagagcgacaacgtgccctccgaagaggtggtcaagaagatgaagaactactggcgacagctgctgaacgccaagctgattacccagcggaagttcgacaatctgaccaaggccgaaagaggcggcctgagcgaactggataaggccggcttcatcaagagacagctggtggaaacccggcagatcacaaagcacgtggcacagattctggactctcggatgaacactaagtacgacgagaacgacaaactgatccgcgaagtgaaagtcatcaccctgaagtccaagctggtgtccgatttccggaaggatttccagttctacaaagtgcgcgagatcaacaactaccatcacgcccacgacgcctacctgaatgccgttgttggaacagccctgatcaaaaagtaccctaagctggaaagcgagttcgtgtacggcgactacaaggtgtacgacgtgcggaagatgatcgccaagagcgagcaagagattggcaaggcaaccgccaagtacttcttctacagcaacatcatgaactttttcaagacagagatcaccctcgccaacggcgagatcagaaagcggcctctgatcgagacaaacggcgaaaccggcgagattgtgtgggataagggcagagactttgccacagtgcggaaagtgctgagcatgccccaagtgaatatcgtgaagaaaaccgaggtgcagacaggcggcttcagcaaagagtctatcctgcctaagcggaactccgacaagctgatcgccagaaagaaggactgggaccccaagaagtacggcggcttcgattctcctaccgtggcctatagcgtgctggtggtggccaaagtggaaaagggcaagtccaagaaactcaagagcgtgaaagagctgctggggatcaccatcatggaaagaagcagcttcgagaagaatccgatcgatttcctcgaggccaagggctacaaagaagtgaaaaaggacctgatcatcaagctccccaagtactccctgttcgagctggaaaacggccggaagagaatgctggcctctgctggcgaactgcagaagggaaacgaactggccctgcctagcaaatatgtgaacttcctgtacctggccagccactatgagaagctgaagggcagccccgaggacaatgagcaaaagcagctgtttgtggaacagcacaagcactacctggacgagatcatcgagcagatcagcgagtttagcaagagagtgattctggccgacgccaatctggacaaagtgctgtccgcctacaacaagcaccgggacaagcctatcagagagcaggccgagaatatcatccacctgtttaccctgaccaacctgggagcccctgccgccttcaagtactttgacaccaccatcgaccggaagcggtacacctccaccaaagaggtgctggacgccactctgatccaccagtctatcaccggcctgtacgagacacggatcgacctgtctcaactcggaggcgacgaaggcgccgataagagaaccgccgatggctctgagttcgagagccccaagaaaaagcgcaaagtgtga

SEQ ID NO: 150 - DNA, 2916 bp, Artificial Sequence
  Description of Artificial Sequence: Synthetic polynucleotide
atggtcaagatcatcagcagaaagagcctgggcacccagaacgtgtacgatatcggagtgggcgagccccacaactttctgctcaagaatggcctggtggccagcaactgcagaggcaatagcagattcgcctggatgaccagaaagagcgaggaaaccatcactccctggaacttcgaggaagtggtggacaagggcgccagcgctcagtccttcatcgagcggatgaccaacttcgataagaacctgcctaacgagaaggtgctgcccaagcacagcctgctgtacgagtacttcaccgtgtacaacgagctgaccaaagtgaaatacgtgaccgagggaatgagaaagcccgcctttctgagcggcgagcagaaaaaggccatcgtggatctgctgttcaagaccaaccggaaagtgaccgtgaagcagctgaaagaggactacttcaagaaaatcgagtgcttcgacagcgtcgagatctccggcgtggaagatcggttcaatgccagcctgggcacataccacgatctgctgaaaattatcaaggacaaggacttcctggacaacgaagagaacgaggacatccttgaggacatcgtgctgacactgaccctgtttgaggacagagagatgatcgaggaacggctgaaaacatacgcccacctgttcgacgacaaagtgatgaagcaactgaagcggcggagatacaccggctggggcagactgtctcggaagctgatcaacggcatccgggataagcagtccggcaagaccatcctggactttctgaagtccgacggcttcgccaacagaaacttcatgcagctgattcacgacgacagcctcaccttcaaagaggatatccagaaagcccaggtgtccggccagggcgattctctgcatgagcacattgccaacctggccggctctcccgccattaagaaaggcatcctgcagacagtgaaggtggtggacgagcttgtgaaagtgatgggcagacacaagcccgagaacatcgtgatcgaaatggccagagagaaccagaccacacagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatggacgggatatgtacgtggaccaagagctggacatcaacagactgtccgactacgatgtggaccatatcgtgccccagtcttttctgaaggacgactccatcgacaacaaggtcctgaccagatccgacaagaatcggggcaagagcgacaacgtgccctccgaagaggtggtcaagaagatgaagaactactggcgacagctgctgaacgccaagctgattacccagcggaagttcgacaatctgaccaaggccgaaagaggcggcctgagcgaactggataaggccggcttcatcaagagacagctggtggaaacccggcagatcacaaagcacgtggcacagattctggactctcggatgaacactaagtacgacgagaacgacaaactgatccgcgaagtgaaagtcatcaccctgaagtccaagctggtgtccgatttccggaaggatttccagttctacaaagtgcgcgagatcaacaactaccatcacgcccacgacgcctacctgaatgccgttgttggaacagccctgatcaaaaagtaccctaagctggaaagcgagttcgtgtacggcgactacaaggtgtacgacgtgcggaagatgatcgccaagagcgagcaagagattggcaaggcaaccgccaagtacttcttctacagcaacatcatgaactttttcaagacagagatcaccctcgccaacggcgagatcagaaagcggcctctgatcgagacaaacggcgaaaccggcgagattgtgtgggataagggcagagactttgccacagtgcggaaagtgctgagcatgccccaagtgaatatcgtgaagaaaaccgaggtgcagacaggcggcttcagcaaagagtctatcctgcctaagcggaactccgacaagctgatcgccagaaagaaggactgggaccccaagaagtacggcggcttcgattctcctaccgtggcctatagcgtgctggtggtggccaaagtggaaaagggcaagtccaagaaactcaagagcgtgaaagagctgctggggatcaccatcatggaaagaagcagcttcgagaagaatccgatcgatttcctcgaggccaagggctacaaagaagtgaaaaaggacctgatcatcaagctccccaagtactccctgttcgagctggaaaacggccggaagagaatgctggcctctgctggcgaactgcagaagggaaacgaactggccctgcctagcaaatatgtgaacttcctgtacctggccagccactatgagaagctgaagggcagccccgaggacaatgagcaaaagcagctgtttgtggaacagcacaagcactacctggacgagatcatcgagcagatcagcgagtttagcaagagagtgattctggccgacgccaatctggacaaagtgctgtccgcctacaacaagcaccgggacaagcctatcagagagcaggccgagaatatcatccacctgtttaccctgaccaacctgggagcccctgccgccttcaagtactttgacaccaccatcgaccggaagcggtacacctccaccaaagaggtgctggacgccactctgatccaccagtctatcaccggcctgtacgagacacggatcgacctgtctcaactcggaggcgacgaaggcgccgataagagaaccgccgatggctctgagttcgagagccccaagaaaaagcgcaaagtgtga

SEQ ID NO: 151 - DNA, 2904 bp, Artificial Sequence
  Description of Artificial Sequence: Synthetic polynucleotide
atggtcaagatcatcagcagaaagagcctgggcacccagaacgtgtacgatatcggagtgggcgagccccacaactttctgctcaagaatggcctggtggccagcaactgcagattcgcctggatgaccagaaagagcgaggaaaccatcactccctggaacttcgaggaagtggtggacaagggcgccagcgctcagtccttcatcgagcggatgaccaacttcgataagaacctgcctaacgagaaggtgctgcccaagcacagcctgctgtacgagtacttcaccgtgtacaacgagctgaccaaagtgaaatacgtgaccgagggaatgagaaagcccgcctttctgagcggcgagcagaaaaaggccatcgtggatctgctgttcaagaccaaccggaaagtgaccgtgaagcagctgaaagaggactacttcaagaaaatcgagtgcttcgacagcgtcgagatctccggcgtggaagatcggttcaatgccagcctgggcacataccacgatctgctgaaaattatcaaggacaaggacttcctggacaacgaagagaacgaggacatccttgaggacatcgtgctgacactgaccctgtttgaggacagagagatgatcgaggaacggctgaaaacatacgcccacctgttcgacgacaaagtgatgaagcaactgaagcggcggagatacaccggctggggcagactgtctcggaagctgatcaacggcatccgggataagcagtccggcaagaccatcctggactttctgaagtccgacggcttcgccaacagaaacttcatgcagctgattcacgacgacagcctcaccttcaaagaggatatccagaaagcccaggtgtccggccagggcgattctctgcatgagcacattgccaacctggccggctctcccgccattaagaaaggcatcctgcagacagtgaaggtggtggacgagcttgtgaaagtgatgggcagacacaagcccgagaacatcgtgatcgaaatggccagagagaaccagaccacacagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatggacgggatatgtacgtggaccaagagctggacatcaacagactgtccgactacgatgtggaccatatcgtgccccagtcttttctgaaggacgactccatcgacaacaaggtcctgaccagatccgacaagaatcggggcaagagcgacaacgtgccctccgaagaggtggtcaagaagatgaagaactactggcgacagctgctgaacgccaagctgattacccagcggaagttcgacaatctgaccaaggccgaaagaggcggcctgagcgaactggataaggccggcttcatcaagagacagctggtggaaacccggcagatcacaaagcacgtggcacagattctggactctcggatgaacactaagtacgacgagaacgacaaactgatccgcgaagtgaaagtcatcaccctgaagtccaagctggtgtccgatttccggaaggatttccagttctacaaagtgcgcgagatcaacaactaccatcacgcccacgacgcctacctgaatgccgttgttggaacagccctgatcaaaaagtaccctaagctggaaagcgagttcgtgtacggcgactacaaggtgtacgacgtgcggaagatgatcgccaagagcgagcaagagattggcaaggcaaccgccaagtacttcttctacagcaacatcatgaactttttcaagacagagatcaccctcgccaacggcgagatcagaaagcggcctctgatcgagacaaacggcgaaaccggcgagattgtgtgggataagggcagagactttgccacagtgcggaaagtgctgagcatgccccaagtgaatatcgtgaagaaaaccgaggtgcagacaggcggcttcagcaaagagtctatcctgcctaagcggaactccgacaagctgatcgccagaaagaaggactgggaccccaagaagtacggcggcttcgattctcctaccgtggcctatagcgtgctggtggtggccaaagtggaaaagggcaagtccaagaaactcaagagcgtgaaagagctgctggggatcaccatcatggaaagaagcagcttcgagaagaatccgatcgatttcctcgaggccaagggctacaaagaagtgaaaaaggacctgatcatcaagctccccaagtactccctgttcgagctggaaaacggccggaagagaatgctggcctctgctggcgaactgcagaagggaaacgaactggccctgcctagcaaatatgtgaacttcctgtacctggccagccactatgagaagctgaagggcagccccgaggacaatgagcaaaagcagctgtttgtggaacagcacaagcactacctggacgagatcatcgagcagatcagcgagtttagcaagagagtgattctggccgacgccaatctggacaaagtgctgtccgcctacaacaagcaccgggacaagcctatcagagagcaggccgagaatatcatccacctgtttaccctgaccaacctgggagcccctgccgccttcaagtactttgacaccaccatcgaccggaagcggtacacctccaccaaagaggtgctggacgccactctgatccaccagtctatcaccggcctgtacgagacacggatcgacctgtctcaactcggaggcgacgaaggcgccgataagagaaccgccgatggctctgagttcgagagccccaagaaaaagcgcaaagtgtga

SEQ ID NO: 152 - DNA, 2895 bp, Artificial Sequence
  Description of Artificial Sequence: Synthetic polynucleotide
atggtcaagatcatcagcagaaagagcctgggcacccagaacgtgtacgatatcggagtgggcgagccccacaactttctgctcaagaatggcctggtggccagcaactgctggatgaccagaaagagcgaggaaaccatcactccctggaacttcgaggaagtggtggacaagggcgccagcgctcagtccttcatcgagcggatgaccaacttcgataagaacctgcctaacgagaaggtgctgcccaagcacagcctgctgtacgagtacttcaccgtgtacaacgagctgaccaaagtgaaatacgtgaccgagggaatgagaaagcccgcctttctgagcggcgagcagaaaaaggccatcgtggatctgctgttcaagaccaaccggaaagtgaccgtgaagcagctgaaagaggactacttcaagaaaatcgagtgcttcgacagcgtcgagatctccggcgtggaagatcggttcaatgccagcctgggcacataccacgatctgctgaaaattatcaaggacaaggacttcctggacaacgaagagaacgaggacatccttgaggacatcgtgctgacactgaccctgtttgaggacagagagatgatcgaggaacggctgaaaacatacgcccacctgttcgacgacaaagtgatgaagcaactgaagcggcggagatacaccggctggggcagactgtctcggaagctgatcaacggcatccgggataagcagtccggcaagaccatcctggactttctgaagtccgacggcttcgccaacagaaacttcatgcagctgattcacgacgacagcctcaccttcaaagaggatatccagaaagcccaggtgtccggccagggcgattctctgcatgagcacattgccaacctggccggctctcccgccattaagaaaggcatcctgcagacagtgaaggtggtggacgagcttgtgaaagtgatgggcagacacaagcccgagaacatcgtgatcgaaatggccagagagaaccagaccacacagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatggacgggatatgtacgtggaccaagagctggacatcaacagactgtccgactacgatgtggaccatatcgtgccccagtcttttctgaaggacgactccatcgacaacaaggtcctgaccagatccgacaagaatcggggcaagagcgacaacgtgccctccgaagaggtggtcaagaagatgaagaactactggcgacagctgctgaacgccaagctgattacccagcggaagttcgacaatctgaccaaggccgaaagaggcggcctgagcgaactggataaggccggcttcatcaagagacagctggtggaaacccggcagatcacaaagcacgtggcacagattctggactctcggatgaacactaagtacgacgagaacgacaaactgatccgcgaagtgaaagtcatcaccctgaagtccaagctggtgtccgatttccggaaggatttccagttctacaaagtgcgcgagatcaacaactaccatcacgcccacgacgcctacctgaatgccgttgttggaacagccctgatcaaaaagtaccctaagctggaaagcgagttcgtgtacggcgactacaaggtgtacgacgtgcggaagatgatcgccaagagcgagcaagagattggcaaggcaaccgccaagtacttcttctacagcaacatcatgaactttttcaagacagagatcaccctcgccaacggcgagatcagaaagcggcctctgatcgagacaaacggcgaaaccggcgagattgtgtgggataagggcagagactttgccacagtgcggaaagtgctgagcatgccccaagtgaatatcgtgaagaaaaccgaggtgcagacaggcggcttcagcaaagagtctatcctgcctaagcggaactccgacaagctgatcgccagaaagaaggactgggaccccaagaagtacggcggcttcgattctcctaccgtggcctatagcgtgctggtggtggccaaagtggaaaagggcaagtccaagaaactcaagagcgtgaaagagctgctggggatcaccatcatggaaagaagcagcttcgagaagaatccgatcgatttcctcgaggccaagggctacaaagaagtgaaaaaggacctgatcatcaagctccccaagtactccctgttcgagctggaaaacggccggaagagaatgctggcctctgctggcgaactgcagaagggaaacgaactggccctgcctagcaaatatgtgaacttcctgtacctggccagccactatgagaagctgaagggcagccccgaggacaatgagcaaaagcagctgtttgtggaacagcacaagcactacctggacgagatcatcgagcagatcagcgagtttagcaagagagtgattctggccgacgccaatctggacaaagtgctgtccgcctacaacaagcaccgggacaagcctatcagagagcaggccgagaatatcatccacctgtttaccctgaccaacctgggagcccctgccgccttcaagtactttgacaccaccatcgaccggaagcggtacacctccaccaaagaggtgctggacgccactctgatccaccagtctatcaccggcctgtacgagacacggatcgacctgtctcaactcggaggcgacgaaggcgccgataagagaaccgccgatggctctgagttcgagagccccaagaaaaagcgcaaagtgtga

SEQ ID NO: 153 - DNA, 2886 bp, Artificial Sequence
  Description of Artificial Sequence: Synthetic polynucleotide
atggtcaagatcatcagcagaaagagcctgggcacccagaacgtgtacgatatcggagtgggcgagccccacaactttctgctcaagaatggcctggtggccagcaactgcagaaagagcgaggaaaccatcactccctggaacttcgaggaagtggtggacaagggcgccagcgctcagtccttcatcgagcggatgaccaacttcgataagaacctgcctaacgagaaggtgctgcccaagcacagcctgctgtacgagtacttcaccgtgtacaacgagctgaccaaagtgaaatacgtgaccgagggaatgagaaagcccgcctttctgagcggcgagcagaaaaaggccatcgtggatctgctgttcaagaccaaccggaaagtgaccgtgaagcagctgaaagaggactacttcaagaaaatcgagtgcttcgacagcgtcgagatctccggcgtggaagatcggttcaatgccagcctgggcacataccacgatctgctgaaaattatcaaggacaaggacttcctggacaacgaagagaacgaggacatccttgaggacatcgtgctgacactgaccctgtttgaggacagagagatgatcgaggaacggctgaaaacatacgcccacctgttcgacgacaaagtgatgaagcaactgaagcggcggagatacaccggctggggcagactgtctcggaagctgatcaacggcatccgggataagcagtccggcaagaccatcctggactttctgaagtccgacggcttcgccaacagaaacttcatgcagctgattcacgacgacagcctcaccttcaaagaggatatccagaaagcccaggtgtccggccagggcgattctctgcatgagcacattgccaacctggccggctctcccgccattaagaaaggcatcctgcagacagtgaaggtggtggacgagcttgtgaaagtgatgggcagacacaagcccgagaacatcgtgatcgaaatggccagagagaaccagaccacacagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatggacgggatatgtacgtggaccaagagctggacatcaacagactgtccgactacgatgtggaccatatcgtgccccagtcttttctgaaggacgactccatcgacaacaaggtcctgaccagatccgacaagaatcggggcaagagcgacaacgtgccctccgaagaggtggtcaagaagatgaagaactactggcgacagctgctgaacgccaagctgattacccagcggaagttcgacaatctgaccaaggccgaaagaggcggcctgagcgaactggataaggccggcttcatcaagagacagctggtggaaacccggcagatcacaaagcacgtggcacagattctggactctcggatgaacactaagtacgacgagaacgacaaactgatccgcgaagtgaaagtcatcaccctgaagtccaagctggtgtccgatttccggaaggatttccagttctacaaagtgcgcgagatcaacaactaccatcacgcccacgacgcctacctgaatgccgttgttggaacagccctgatcaaaaagtaccctaagctggaaagcgagttcgtgtacggcgactacaaggtgtacgacgtgcggaagatgatcgccaagagcgagcaagagattggcaaggcaaccgccaagtacttcttctacagcaacatcatgaactttttcaagacagagatcaccctcgccaacggcgagatcagaaagcggcctctgatcgagacaaacggcgaaaccggcgagattgtgtgggataagggcagagactttgccacagtgcggaaagtgctgagcatgccccaagtgaatatcgtgaagaaaaccgaggtgcagacaggcggcttcagcaaagagtctatcctgcctaagcggaactccgacaagctgatcgccagaaagaaggactgggaccccaagaagtacggcggcttcgattctcctaccgtggcctatagcgtgctggtggtggccaaagtggaaaagggcaagtccaagaaactcaagagcgtgaaagagctgctggggatcaccatcatggaaagaagcagcttcgagaagaatccgatcgatttcctcgaggccaagggctacaaagaagtgaaaaaggacctgatcatcaagctccccaagtactccctgttcgagctggaaaacggccggaagagaatgctggcctctgctggcgaactgcagaagggaaacgaactggccctgcctagcaaatatgtgaacttcctgtacctggccagccactatgagaagctgaagggcagccccgaggacaatgagcaaaagcagctgtttgtggaacagcacaagcactacctggacgagatcatcgagcagatcagcgagtttagcaagagagtgattctggccgacgccaatctggacaaagtgctgtccgcctacaacaagcaccgggacaagcctatcagagagcaggccgagaatatcatccacctgtttaccctgaccaacctgggagcccctgccgccttcaagtactttgacaccaccatcgaccggaagcggtacacctccaccaaagaggtgctggacgccactctgatccaccagtctatcaccggcctgtacgagacacggatcgacctgtctcaactcggaggcgacgaaggcgccgataagagaaccgccgatggctctgagttcgagagccccaagaaaaagcgcaaagtgtga

SEQ ID NO: 154 - DNA, 2877 bp, Artificial Sequence
  Description of Artificial Sequence: Synthetic polynucleotide
atggtcaagatcatcagcagaaagagcctgggcacccagaacgtgtacgatatcggagtgggcgagccccacaactttctgctcaagaatggcctggtggccagcaactgcgaggaaaccatcactccctggaacttcgaggaagtggtggacaagggcgccagcgctcagtccttcatcgagcggatgaccaacttcgataagaacctgcctaacgagaaggtgctgcccaagcacagcctgctgtacgagtacttcaccgtgtacaacgagctgaccaaagtgaaatacgtgaccgagggaatgagaaagcccgcctttctgagcggcgagcagaaaaaggccatcgtggatctgctgttcaagaccaaccggaaagtgaccgtgaagcagctgaaagaggactacttcaagaaaatcgagtgcttcgacagcgtcgagatctccggcgtggaagatcggttcaatgccagcctgggcacataccacgatctgctgaaaattatcaaggacaaggacttcctggacaacgaagagaacgaggacatccttgaggacatcgtgctgacactgaccctgtttgaggacagagagatgatcgaggaacggctgaaaacatacgcccacctgttcgacgacaaagtgatgaagcaactgaagcggcggagatacaccggctggggcagactgtctcggaagctgatcaacggcatccgggataagcagtccggcaagaccatcctggactttctgaagtccgacggcttcgccaacagaaacttcatgcagctgattcacgacgacagcctcaccttcaaagaggatatccagaaagcccaggtgtccggccagggcgattctctgcatgagcacattgccaacctggccggctctcccgccattaagaaaggcatcctgcagacagtgaaggtggtggacgagcttgtgaaagtgatgggcagacacaagcccgagaacatcgtgatcgaaatggccagagagaaccagaccacacagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatggacgggatatgtacgtggaccaagagctggacatcaacagactgtccgactacgatgtggaccatatcgtgccccagtcttttctgaaggacgactccatcgacaacaaggtcctgaccagatccgacaagaatcggggcaagagcgacaacgtgccctccgaagaggtggtcaagaagatgaagaactactggcgacagctgctgaacgccaagctgattacccagcggaagttcgacaatctgaccaaggccgaaagaggcggcctgagcgaactggataaggccggcttcatcaagagacagctggtggaaacccggcagatcacaaagcacgtggcacagattctggactctcggatgaacactaagtacgacgagaacgacaaactgatccgcgaagtgaaagtcatcaccctgaagtccaagctggtgtccgatttccggaaggatttccagttctacaaagtgcgcgagatcaacaactaccatcacgcccacgacgcctacctgaatgccgttgttggaacagccctgatcaaaaagtaccctaagctggaaagcgagttcgtgtacggcgactacaaggtgtacgacgtgcggaagatgatcgccaagagcgagcaagagattggcaaggcaaccgccaagtacttcttctacagcaacatcatgaactttttcaagacagagatcaccctcgccaacggcgagatcagaaagcggcctctgatcgagacaaacggcgaaaccggcgagattgtgtgggataagggcagagactttgccacagtgcggaaagtgctgagcatgccccaagtgaatatcgtgaagaaaaccgaggtgcagacaggcggcttcagcaaagagtctatcctgcctaagcggaactccgacaagctgatcgccagaaagaaggactgggaccccaagaagtacggcggcttcgattctcctaccgtggcctatagcgtgctggtggtggccaaagtggaaaagggcaagtccaagaaactcaagagcgtgaaagagctgctggggatcaccatcatggaaagaagcagcttcgagaagaatccgatcgatttcctcgaggccaagggctacaaagaagtgaaaaaggacctgatcatcaagctccccaagtactccctgttcgagctggaaaacggccggaagagaatgctggcctctgctggcgaactgcagaagggaaacgaactggccctgcctagcaaatatgtgaacttcctgtacctggccagccactatgagaagctgaagggcagccccgaggacaatgagcaaaagcagctgtttgtggaacagcacaagcactacctggacgagatcatcgagcagatcagcgagtttagcaagagagtgattctggccgacgccaatctggacaaagtgctgtccgcctacaacaagcaccgggacaagcctatcagagagcaggccgagaatatcatccacctgtttaccctgaccaacctgggagcccctgccgccttcaagtactttgacaccaccatcgaccggaagcggtacacctccaccaaagaggtgctggacgccactctgatccaccagtctatcaccggcctgtacgagacacggatcgacctgtctcaactcggaggcgacgaaggcgccgataagagaaccgccgatggctctgagttcgagagccccaagaaaaagcgcaaagtgtga

SEQ ID NO: 155 - DNA, 2868 bp, Artificial Sequence
  Description of Artificial Sequence: Synthetic polynucleotide
atggtcaagatcatcagcagaaagagcctgggcacccagaacgtgtacgatatcggagtgggcgagccccacaactttctgctcaagaatggcctggtggccagcaactgcatcactccctggaacttcgaggaagtggtggacaagggcgccagcgctcagtccttcatcgagcggatgaccaacttcgataagaacctgcctaacgagaaggtgctgcccaagcacagcctgctgtacgagtacttcaccgtgtacaacgagctgaccaaagtgaaatacgtgaccgagggaatgagaaagcccgcctttctgagcggcgagcagaaaaaggccatcgtggatctgctgttcaagaccaaccggaaagtgaccgtgaagcagctgaaagaggactacttcaagaaaatcgagtgcttcgacagcgtcgagatctccggcgtggaagatcggttcaatgccagcctgggcacataccacgatctgctgaaaattatcaaggacaaggacttcctggacaacgaagagaacgaggacatccttgaggacatcgtgctgacactgaccctgtttgaggacagagagatgatcgaggaacggctgaaaacatacgcccacctgttcgacgacaaagtgatgaagcaactgaagcggcggagatacaccggctggggcagactgtctcggaagctgatcaacggcatccgggataagcagtccggcaagaccatcctggactttctgaagtccgacggcttcgccaacagaaacttcatgcagctgattcacgacgacagcctcaccttcaaagaggatatccagaaagcccaggtgtccggccagggcgattctctgcatgagcacattgccaacctggccggctctcccgccattaagaaaggcatcctgcagacagtgaaggtggtggacgagcttgtgaaagtgatgggcagacacaagcccgagaacatcgtgatcgaaatggccagagagaaccagaccacacagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatggacgggatatgtacgtggaccaagagctggacatcaacagactgtccgactacgatgtggaccatatcgtgccccagtcttttctgaaggacgactccatcgacaacaaggtcctgaccagatccgacaagaatcggggcaagagcgacaacgtgccctccgaagaggtggtcaagaagatgaagaactactggcgacagctgctgaacgccaagctgattacccagcggaagttcgacaatctgaccaaggccgaaagaggcggcctgagcgaactggataaggccggcttcatcaagagacagctggtggaaacccggcagatcacaaagcacgtggcacagattctggactctcggatgaacactaagtacgacgagaacgacaaactgatccgcgaagtgaaagtcatcaccctgaagtccaagctggtgtccgatttccggaaggatttccagttctacaaagtgcgcgagatcaacaactaccatcacgcccacgacgcctacctgaatgccgttgttggaacagccctgatcaaaaagtaccctaagctggaaagcgagttcgtgtacggcgactacaaggtgtacgacgtgcggaagatgatcgccaagagcgagcaagagattggcaaggcaaccgccaagtacttcttctacagcaacatcatgaactttttcaagacagagatcaccctcgccaacggcgagatcagaaagcggcctctgatcgagacaaacggcgaaaccggcgagattgtgtgggataagggcagagactttgccacagtgcggaaagtgctgagcatgccccaagtgaatatcgtgaagaaaaccgaggtgcagacaggcggcttcagcaaagagtctatcctgcctaagcggaactccgacaagctgatcgccagaaagaaggactgggaccccaagaagtacggcggcttcgattctcctaccgtggcctatagcgtgctggtggtggccaaagtggaaaagggcaagtccaagaaactcaagagcgtgaaagagctgctggggatcaccatcatggaaagaagcagcttcgagaagaatccgatcgatttcctcgaggccaagggctacaaagaagtgaaaaaggacctgatcatcaagctccccaagtactccctgttcgagctggaaaacggccggaagagaatgctggcctctgctggcgaactgcagaagggaaacgaactggccctgcctagcaaatatgtgaacttcctgtacctggccagccactatgagaagctgaagggcagccccgaggacaatgagcaaaagcagctgtttgtggaacagcacaagcactacctggacgagatcatcgagcagatcagcgagtttagcaagagagtgattctggccgacgccaatctggacaaagtgctgtccgcctacaacaagcaccgggacaagcctatcagagagcaggccgagaatatcatccacctgtttaccctgaccaacctgggagcccctgccgccttcaagtactttgacaccaccatcgaccggaagcggtacacctccaccaaagaggtgctggacgccactctgatccaccagtctatcaccggcctgtacgagacacggatcgacctgtctcaactcggaggcgacgaaggcgccgataagagaaccgccgatggctctgagttcgagagccccaagaaaaagcgcaaagtgtga

SEQ ID NO: 156 - DNA, 2862 bp, Artificial Sequence
  Description of Artificial Sequence: Synthetic polynucleotide
atggtcaagatcatcagcagaaagagcctgggcacccagaacgtgtacgatatcggagtgggcgagccccacaactttctgctcaagaatggcctggtggccagcaactgcccctggaacttcgaggaagtggtggacaagggcgccagcgctcagtccttcatcgagcggatgaccaacttcgataagaacctgcctaacgagaaggtgctgcccaagcacagcctgctgtacgagtacttcaccgtgtacaacgagctgaccaaagtgaaatacgtgaccgagggaatgagaaagcccgcctttctgagcggcgagcagaaaaaggccatcgtggatctgctgttcaagaccaaccggaaagtgaccgtgaagcagctgaaagaggactacttcaagaaaatcgagtgcttcgacagcgtcgagatctccggcgtggaagatcggttcaatgccagcctgggcacataccacgatctgctgaaaattatcaaggacaaggacttcctggacaacgaagagaacgaggacatccttgaggacatcgtgctgacactgaccctgtttgaggacagagagatgatcgaggaacggctgaaaacatacgcccacctgttcgacgacaaagtgatgaagcaactgaagcggcggagatacaccggctggggcagactgtctcggaagctgatcaacggcatccgggataagcagtccggcaagaccatcctggactttctgaagtccgacggcttcgccaacagaaacttcatgcagctgattcacgacgacagcctcaccttcaaagaggatatccagaaagcccaggtgtccggccagggcgattctctgcatgagcacattgccaacctggccggctctcccgccattaagaaaggcatcctgcagacagtgaaggtggtggacgagcttgtgaaagtgatgggcagacacaagcccgagaacatcgtgatcgaaatggccagagagaaccagaccacacagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatggacgggatatgtacgtggaccaagagctggacatcaacagactgtccgactacgatgtggaccatatcgtgccccagtcttttctgaaggacgactccatcgacaacaaggtcctgaccagatccgacaagaatcggggcaagagcgacaacgtgccctccgaagaggtggtcaagaagatgaagaactactggcgacagctgctgaacgccaagctgattacccagcggaagttcgacaatctgaccaaggccgaaagaggcggcctgagcgaactggataaggccggcttcatcaagagacagctggtggaaacccggcagatcacaaagcacgtggcacagattctggactctcggatgaacactaagtacgacgagaacgacaaactgatccgcgaagtgaaagtcatcaccctgaagtccaagctggtgtccgatttccggaaggatttccagttctacaaagtgcgcgagatcaacaactaccatcacgcccacgacgcctacctgaatgccgttgttggaacagccctgatcaaaaagtaccctaagctggaaagcgagttcgtgtacggcgactacaaggtgtacgacgtgcggaagatgatcgccaagagcgagcaagagattggcaaggcaaccgccaagtacttcttctacagcaacatcatgaactttttcaagacagagatcaccctcgccaacggcgagatcagaaagcggcctctgatcgagacaaacggcgaaaccggcgagattgtgtgggataagggcagagactttgccacagtgcggaaagtgctgagcatgccccaagtgaatatcgtgaagaaaaccgaggtgcagacaggcggcttcagcaaagagtctatcctgcctaagcggaactccgacaagctgatcgccagaaagaaggactgggaccccaagaagtacggcggcttcgattctcctaccgtggcctatagcgtgctggtggtggccaaagtggaaaagggcaagtccaagaaactcaagagcgtgaaagagctgctggggatcaccatcatggaaagaagcagcttcgagaagaatccgatcgatttcctcgaggccaagggctacaaagaagtgaaaaaggacctgatcatcaagctccccaagtactccctgttcgagctggaaaacggccggaagagaatgctggcctctgctggcgaactgcagaagggaaacgaactggccctgcctagcaaatatgtgaacttcctgtacctggccagccactatgagaagctgaagggcagccccgaggacaatgagcaaaagcagctgtttgtggaacagcacaagcactacctggacgagatcatcgagcagatcagcgagtttagcaagagagtgattctggccgacgccaatctggacaaagtgctgtccgcctacaacaagcaccgggacaagcctatcagagagcaggccgagaatatcatccacctgtttaccctgaccaacctgggagcccctgccgccttcaagtactttgacaccaccatcgaccggaagcggtacacctccaccaaagaggtgctggacgccactctgatccaccagtctatcaccggcctgtacgagacacggatcgacctgtctcaactcggaggcgacgaaggcgccgataagagaaccgccgatggctctgagttcgagagccccaagaaaaagcgcaaagtgtga

SEQ ID NO: 157 - DNA, 2562 bp, Artificial Sequence
  Description of Artificial Sequence: Synthetic polynucleotide
atggtcaagatcatcagcagaaagagcctgggcacccagaacgtgtacgatatcggagtgggcgagccccacaactttctgctcaagaatggcctggtggccagcaactgcttcgacagcgtcgagatctccggcgtggaagatcggttcaatgccagcctgggcacataccacgatctgctgaaaattatcaaggacaaggacttcctggacaacgaagagaacgaggacatccttgaggacatcgtgctgacactgaccctgtttgaggacagagagatgatcgaggaacggctgaaaacatacgcccacctgttcgacgacaaagtgatgaagcaactgaagcggcggagatacaccggctggggcagactgtctcggaagctgatcaacggcatccgggataagcagtccggcaagaccatcctggactttctgaagtccgacggcttcgccaacagaaacttcatgcagctgattcacgacgacagcctcaccttcaaagaggatatccagaaagcccaggtgtccggccagggcgattctctgcatgagcacattgccaacctggccggctctcccgccattaagaaaggcatcctgcagacagtgaaggtggtggacgagcttgtgaaagtgatgggcagacacaagcccgagaacatcgtgatcgaaatggccagagagaaccagaccacacagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatggacgggatatgtacgtggaccaagagctggacatcaacagactgtccgactacgatgtggaccatatcgtgccccagtcttttctgaaggacgactccatcgacaacaaggtcctgaccagatccgacaagaatcggggcaagagcgacaacgtgccctccgaagaggtggtcaagaagatgaagaactactggcgacagctgctgaacgccaagctgattacccagcggaagttcgacaatctgaccaaggccgaaagaggcggcctgagcgaactggataaggccggcttcatcaagagacagctggtggaaacccggcagatcacaaagcacgtggcacagattctggactctcggatgaacactaagtacgacgagaacgacaaactgatccgcgaagtgaaagtcatcaccctgaagtccaagctggtgtccgatttccggaaggatttccagttctacaaagtgcgcgagatcaacaactaccatcacgcccacgacgcctacctgaatgccgttgttggaacagccctgatcaaaaagtaccctaagctggaaagcgagttcgtgtacggcgactacaaggtgtacgacgtgcggaagatgatcgccaagagcgagcaagagattggcaaggcaaccgccaagtacttcttctacagcaacatcatgaactttttcaagacagagatcaccctcgccaacggcgagatcagaaagcggcctctgatcgagacaaacggcgaaaccggcgagattgtgtgggataagggcagagactttgccacagtgcggaaagtgctgagcatgccccaagtgaatatcgtgaagaaaaccgaggtgcagacaggcggcttcagcaaagagtctatcctgcctaagcggaactccgacaagctgatcgccagaaagaaggactgggaccccaagaagtacggcggcttcgattctcctaccgtggcctatagcgtgctggtggtggccaaagtggaaaagggcaagtccaagaaactcaagagcgtgaaagagctgctggggatcaccatcatggaaagaagcagcttcgagaagaatccgatcgatttcctcgaggccaagggctacaaagaagtgaaaaaggacctgatcatcaagctccccaagtactccctgttcgagctggaaaacggccggaagagaatgctggcctctgctggcgaactgcagaagggaaacgaactggccctgcctagcaaatatgtgaacttcctgtacctggccagccactatgagaagctgaagggcagccccgaggacaatgagcaaaagcagctgtttgtggaacagcacaagcactacctggacgagatcatcgagcagatcagcgagtttagcaagagagtgattctggccgacgccaatctggacaaagtgctgtccgcctacaacaagcaccgggacaagcctatcagagagcaggccgagaatatcatccacctgtttaccctgaccaacctgggagcccctgccgccttcaagtactttgacaccaccatcgaccggaagcggtacacctccaccaaagaggtgctggacgccactctgatccaccagtctatcaccggcctgtacgagacacggatcgacctgtctcaactcggaggcgacgaaggcgccgataagagaaccgccgatggctctgagttcgagagccccaagaaaaagcgcaaagtgtga

SEQ ID NO: 158 - DNA, 2553 bp, Artificial Sequence
  Description of Artificial Sequence: Synthetic polynucleotide
atggtcaagatcatcagcagaaagagcctgggcacccagaacgtgtacgatatcggagtgggcgagccccacaactttctgctcaagaatggcctggtggccagcaactgcgtcgagatctccggcgtggaagatcggttcaatgccagcctgggcacataccacgatctgctgaaaattatcaaggacaaggacttcctggacaacgaagagaacgaggacatccttgaggacatcgtgctgacactgaccctgtttgaggacagagagatgatcgaggaacggctgaaaacatacgcccacctgttcgacgacaaagtgatgaagcaactgaagcggcggagatacaccggctggggcagactgtctcggaagctgatcaacggcatccgggataagcagtccggcaagaccatcctggactttctgaagtccgacggcttcgccaacagaaacttcatgcagctgattcacgacgacagcctcaccttcaaagaggatatccagaaagcccaggtgtccggccagggcgattctctgcatgagcacattgccaacctggccggctctcccgccattaagaaaggcatcctgcagacagtgaaggtggtggacgagcttgtgaaagtgatgggcagacacaagcccgagaacatcgtgatcgaaatggccagagagaaccagaccacacagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatggacgggatatgtacgtggaccaagagctggacatcaacagactgtccgactacgatgtggaccatatcgtgccccagtcttttctgaaggacgactccatcgacaacaaggtcctgaccagatccgacaagaatcggggcaagagcgacaacgtgccctccgaagaggtggtcaagaagatgaagaactactggcgacagctgctgaacgccaagctgattacccagcggaagttcgacaatctgaccaaggccgaaagaggcggcctgagcgaactggataaggccggcttcatcaagagacagctggtggaaacccggcagatcacaaagcacgtggcacagattctggactctcggatgaacactaagtacgacgagaacgacaaactgatccgcgaagtgaaagtcatcaccctgaagtccaagctggtgtccgatttccggaaggatttccagttctacaaagtgcgcgagatcaacaactaccatcacgcccacgacgcctacctgaatgccgttgttggaacagccctgatcaaaaagtaccctaagctggaaagcgagttcgtgtacggcgactacaaggtgtacgacgtgcggaagatgatcgccaagagcgagcaagagattggcaaggcaaccgccaagtacttcttctacagcaacatcatgaactttttcaagacagagatcaccctcgccaacggcgagatcagaaagcggcctctgatcgagacaaacggcgaaaccggcgagattgtgtgggataagggcagagactttgccacagtgcggaaagtgctgagcatgccccaagtgaatatcgtgaagaaaaccgaggtgcagacaggcggcttcagcaaagagtctatcctgcctaagcggaactccgacaagctgatcgccagaaagaaggactgggaccccaagaagtacggcggcttcgattctcctaccgtggcctatagcgtgctggtggtggccaaagtggaaaagggcaagtccaagaaactcaagagcgtgaaagagctgctggggatcaccatcatggaaagaagcagcttcgagaagaatccgatcgatttcctcgaggccaagggctacaaagaagtgaaaaaggacctgatcatcaagctccccaagtactccctgttcgagctggaaaacggccggaagagaatgctggcctctgctggcgaactgcagaagggaaacgaactggccctgcctagcaaatatgtgaacttcctgtacctggccagccactatgagaagctgaagggcagccccgaggacaatgagcaaaagcagctgtttgtggaacagcacaagcactacctggacgagatcatcgagcagatcagcgagtttagcaagagagtgattctggccgacgccaatctggacaaagtgctgtccgcctacaacaagcaccgggacaagcctatcagagagcaggccgagaatatcatccacctgtttaccctgaccaacctgggagcccctgccgccttcaagtactttgacaccaccatcgaccggaagcggtacacctccaccaaagaggtgctggacgccactctgatccaccagtctatcaccggcctgtacgagacacggatcgacctgtctcaactcggaggcgacgaaggcgccgataagagaaccgccgatggctctgagttcgagagccccaagaaaaagcgcaaagtgtga

SEQ ID NO: 159 - DNA, 2517 bp, Artificial Sequence
  Description of Artificial Sequence: Synthetic polynucleotide
atggtcaagatcatcagcagaaagagcctgggcacccagaacgtgtacgatatcggagtgggcgagccccacaactttctgctcaagaatggcctggtggccagcaactgcagcctgggcacataccacgatctgctgaaaattatcaaggacaaggacttcctggacaacgaagagaacgaggacatccttgaggacatcgtgctgacactgaccctgtttgaggacagagagatgatcgaggaacggctgaaaacatacgcccacctgttcgacgacaaagtgatgaagcaactgaagcggcggagatacaccggctggggcagactgtctcggaagctgatcaacggcatccgggataagcagtccggcaagaccatcctggactttctgaagtccgacggcttcgccaacagaaacttcatgcagctgattcacgacgacagcctcaccttcaaagaggatatccagaaagcccaggtgtccggccagggcgattctctgcatgagcacattgccaacctggccggctctcccgccattaagaaaggcatcctgcagacagtgaaggtggtggacgagcttgtgaaagtgatgggcagacacaagcccgagaacatcgtgatcgaaatggccagagagaaccagaccacacagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatggacgggatatgtacgtggaccaagagctggacatcaacagactgtccgactacgatgtggaccatatcgtgccccagtcttttctgaaggacgactccatcgacaacaaggtcctgaccagatccgacaagaatcggggcaagagcgacaacgtgccctccgaagaggtggtcaagaagatgaagaactactggcgacagctgctgaacgccaagctgattacccagcggaagttcgacaatctgaccaaggccgaaagaggcggcctgagcgaactggataaggccggcttcatcaagagacagctggtggaaacccggcagatcacaaagcacgtggcacagattctggactctcggatgaacactaagtacgacgagaacgacaaactgatccgcgaagtgaaagtcatcaccctgaagtccaagctggtgtccgatttccggaaggatttccagttctacaaagtgcgcgagatcaacaactaccatcacgcccacgacgcctacctgaatgccgttgttggaacagccctgatcaaaaagtaccctaagctggaaagcgagttcgtgtacggcgactacaaggtgtacgacgtgcggaagatgatcgccaagagcgagcaagagattggcaaggcaaccgccaagtacttcttctacagcaacatcatgaactttttcaagacagagatcaccctcgccaacggcgagatcagaaagcggcctctgatcgagacaaacggcgaaaccggcgagattgtgtgggataagggcagagactttgccacagtgcggaaagtgctgagcatgccccaagtgaatatcgtgaagaaaaccgaggtgcagacaggcggcttcagcaaagagtctatcctgcctaagcggaactccgacaagctgatcgccagaaagaaggactgggaccccaagaagtacggcggcttcgattctcctaccgtggcctatagcgtgctggtggtggccaaagtggaaaagggcaagtccaagaaactcaagagcgtgaaagagctgctggggatcaccatcatggaaagaagcagcttcgagaagaatccgatcgatttcctcgaggccaagggctacaaagaagtgaaaaaggacctgatcatcaagctccccaagtactccctgttcgagctggaaaacggccggaagagaatgctggcctctgctggcgaactgcagaagggaaacgaactggccctgcctagcaaatatgtgaacttcctgtacctggccagccactatgagaagctgaagggcagccccgaggacaatgagcaaaagcagctgtttgtggaacagcacaagcactacctggacgagatcatcgagcagatcagcgagtttagcaagagagtgattctggccgacgccaatctggacaaagtgctgtccgcctacaacaagcaccgggacaagcctatcagagagcaggccgagaatatcatccacctgtttaccctgaccaacctgggagcccctgccgccttcaagtactttgacaccaccatcgaccggaagcggtacacctccaccaaagaggtgctggacgccactctgatccaccagtctatcaccggcctgtacgagacacggatcgacctgtctcaactcggaggcgacgaaggcgccgataagagaaccgccgatggctctgagttcgagagccccaagaaaaagcgcaaagtgtga

SEQ ID NO: 160 - DNA, 2514 bp, Artificial Sequence
  Description of Artificial Sequence: Synthetic polynucleotide
atggtcaagatcatcagcagaaagagcctgggcacccagaacgtgtacgatatcggagtgggcgagccccacaactttctgctcaagaatggcctggtggccagcaactgcctgggcacataccacgatctgctgaaaattatcaaggacaaggacttcctggacaacgaagagaacgaggacatccttgaggacatcgtgctgacactgaccctgtttgaggacagagagatgatcgaggaacggctgaaaacatacgcccacctgttcgacgacaaagtgatgaagcaactgaagcggcggagatacaccggctggggcagactgtctcggaagctgatcaacggcatccgggataagcagtccggcaagaccatcctggactttctgaagtccgacggcttcgccaacagaaacttcatgcagctgattcacgacgacagcctcaccttcaaagaggatatccagaaagcccaggtgtccggccagggcgattctctgcatgagcacattgccaacctggccggctctcccgccattaagaaaggcatcctgcagacagtgaaggtggtggacgagcttgtgaaagtgatgggcagacacaagcccgagaacatcgtgatcgaaatggccagagagaaccagaccacacagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatggacgggatatgtacgtggaccaagagctggacatcaacagactgtccgactacgatgtggaccatatcgtgccccagtcttttctgaaggacgactccatcgacaacaaggtcctgaccagatccgacaagaatcggggcaagagcgacaacgtgccctccgaagaggtggtcaagaagatgaagaactactggcgacagctgctgaacgccaagctgattacccagcggaagttcgacaatctgaccaaggccgaaagaggcggcctgagcgaactggataaggccggcttcatcaagagacagctggtggaaacccggcagatcacaaagcacgtggcacagattctggactctcggatgaacactaagtacgacgagaacgacaaactgatccgcgaagtgaaagtcatcaccctgaagtccaagctggtgtccgatttccggaaggatttccagttctacaaagtgcgcgagatcaacaactaccatcacgcccacgacgcctacctgaatgccgttgttggaacagccctgatcaaaaagtaccctaagctggaaagcgagttcgtgtacggcgactacaaggtgtacgacgtgcggaagatgatcgccaagagcgagcaagagattggcaaggcaaccgccaagtacttcttctacagcaacatcatgaactttttcaagacagagatcaccctcgccaacggcgagatcagaaagcggcctctgatcgagacaaacggcgaaaccggcgagattgtgtgggataagggcagagactttgccacagtgcggaaagtgctgagcatgccccaagtgaatatcgtgaagaaaaccgaggtgcagacaggcggcttcagcaaagagtctatcctgcctaagcggaactccgacaagctgatcgccagaaagaaggactgggaccccaagaagtacggcggcttcgattctcctaccgtggcctatagcgtgctggtggtggccaaagtggaaaagggcaagtccaagaaactcaagagcgtgaaagagctgctggggatcaccatcatggaaagaagcagcttcgagaagaatccgatcgatttcctcgaggccaagggctacaaagaagtgaaaaaggacctgatcatcaagctccccaagtactccctgttcgagctggaaaacggccggaagagaatgctggcctctgctggcgaactgcagaagggaaacgaactggccctgcctagcaaatatgtgaacttcctgtacctggccagccactatgagaagctgaagggcagccccgaggacaatgagcaaaagcagctgtttgtggaacagcacaagcactacctggacgagatcatcgagcagatcagcgagtttagcaagagagtgattctggccgacgccaatctggacaaagtgctgtccgcctacaacaagcaccgggacaagcctatcagagagcaggccgagaatatcatccacctgtttaccctgaccaacctgggagcccctgccgccttcaagtactttgacaccaccatcgaccggaagcggtacacctccaccaaagaggtgctggacgccactctgatccaccagtctatcaccggcctgtacgagacacggatcgacctgtctcaactcggaggcgacgaaggcgccgataagagaaccgccgatggctctgagttcgagagccccaagaaaaagcgcaaagtgtga

SEQ ID NO: 161 - protein, 1786 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 162 - protein, 799 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLCLSYDTEILTVEYGFLPIGKIVEERIECTVYTVDKNGFVYTQPIAQWHNRGEQEVFEYCLEDGSIIRATKDHKFMTTDGQMLPIDEIFERGLDLKQVDGLP

SEQ ID NO: 163 - protein, 806 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNCLSYDTEILTVEYGFLPIGKIVEERIECTVYTVDKNGFVYTQPIAQWHNRGEQEVFEYCLEDGSIIRATKDHKFMTTDGQMLPIDEIFERGLDLKQVDGLP

SEQ ID NO: 164 - protein, 809 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEICLSYDTEILTVEYGFLPIGKIVEERIECTVYTVDKNGFVYTQPIAQWHNRGEQEVFEYCLEDGSIIRATKDHKFMTTDGQMLPIDEIFERGLDLKQVDGLP

SEQ ID NO: 165 - protein, 851 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQCLSYDTEILTVEYGFLPIGKIVEERIECTVYTVDKNGFVYTQPIAQWHNRGEQEVFEYCLEDGSIIRATKDHKFMTTDGQMLPIDEIFERGLDLKQVDGLP

SEQ ID NO: 166 - protein, 952 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLCLSYDTEILTVEYGFLPIGKIVEERIECTVYTVDKNGFVYTQPIAQWHNRGEQEVFEYCLEDGSIIRATKDHKFMTTDGQMLPIDEIFERGLDLKQVDGLP

SEQ ID NO: 167 - protein, 956 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNCLSYDTEILTVEYGFLPIGKIVEERIECTVYTVDKNGFVYTQPIAQWHNRGEQEVFEYCLEDGSIIRATKDHKFMTTDGQMLPIDEIFERGLDLKQVDGLP

SEQ ID NO: 168 - protein, 959 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFCLSYDTEILTVEYGFLPIGKIVEERIECTVYTVDKNGFVYTQPIAQWHNRGEQEVFEYCLEDGSIIRATKDHKFMTTDGQMLPIDEIFERGLDLKQVDGLP

SEQ ID NO: 169 - protein, 962 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMCLSYDTEILTVEYGFLPIGKIVEERIECTVYTVDKNGFVYTQPIAQWHNRGEQEVFEYCLEDGSIIRATKDHKFMTTDGQMLPIDEIFERGLDLKQVDGLP

SEQ ID NO: 170 - protein, 965 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKCLSYDTEILTVEYGFLPIGKIVEERIECTVYTVDKNGFVYTQPIAQWHNRGEQEVFEYCLEDGSIIRATKDHKFMTTDGQMLPIDEIFERGLDLKQVDGLP

SEQ ID NO: 171 - protein, 968 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEECLSYDTEILTVEYGFLPIGKIVEERIECTVYTVDKNGFVYTQPIAQWHNRGEQEVFEYCLEDGSIIRATKDHKFMTTDGQMLPIDEIFERGLDLKQVDGLP

SEQ ID NO: 172 - protein, 970 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETICLSYDTEILTVEYGFLPIGKIVEERIECTVYTVDKNGFVYTQPIAQWHNRGEQEVFEYCLEDGSIIRATKDHKFMTTDGQMLPIDEIFERGLDLKQVDGLP

SEQ ID NO: 173 - protein, 1070 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECLSYDTEILTVEYGFLPIGKIVEERIECTVYTVDKNGFVYTQPIAQWHNRGEQEVFEYCLEDGSIIRATKDHKFMTTDGQMLPIDEIFERGLDLKQVDGLP

SEQ ID NO: 174 - protein, 1073 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDCLSYDTEILTVEYGFLPIGKIVEERIECTVYTVDKNGFVYTQPIAQWHNRGEQEVFEYCLEDGSIIRATKDHKFMTTDGQMLPIDEIFERGLDLKQVDGLP

SEQ ID NO: 175 - protein, 1085 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNCLSYDTEILTVEYGFLPIGKIVEERIECTVYTVDKNGFVYTQPIAQWHNRGEQEVFEYCLEDGSIIRATKDHKFMTTDGQMLPIDEIFERGLDLKQVDGLP

SEQ ID NO: 176 - protein, 1086 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNACLSYDTEILTVEYGFLPIGKIVEERIECTVYTVDKNGFVYTQPIAQWHNRGEQEVFEYCLEDGSIIRATKDHKFMTTDGQMLPIDEIFERGLDLKQVDGLP

SEQ ID NO: 177 - protein, 1124 aa, Artificial Sequence
  Description of Artificial Sequence: Synthetic polypeptide
MVKIISRKSLGTQNVYDIGVGEPHNFLLKNGLVASNCDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 178 - protein, 1117 aa, Artificial Sequence
  Description of Artificial Sequence: Synthetic polypeptide
MVKIISRKSLGTQNVYDIGVGEPHNFLLKNGLVASNCEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 179 - protein, 1114 aa, Artificial Sequence
  Description of Artificial Sequence: Synthetic polypeptide
MVKIISRKSLGTQNVYDIGVGEPHNFLLKNGLVASNCKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 180 - protein, 1072 aa, Artificial Sequence
  Description of Artificial Sequence: Synthetic polypeptide
MVKIISRKSLGTQNVYDIGVGEPHNFLLKNGLVASNCKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 181 - protein, 971 aa, Artificial Sequence
  Description of Artificial Sequence: Synthetic polypeptide
MVKIISRKSLGTQNVYDIGVGEPHNFLLKNGLVASNCRGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 182 - protein, 967 aa, Artificial Sequence
  Description of Artificial Sequence: Synthetic polypeptide
MVKIISRKSLGTQNVYDIGVGEPHNFLLKNGLVASNCRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 183 - protein, 964 aa, Artificial Sequence
  Description of Artificial Sequence: Synthetic polypeptide
MVKIISRKSLGTQNVYDIGVGEPHNFLLKNGLVASNCWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 184 - protein, 961 aa, Artificial Sequence
  Description of Artificial Sequence: Synthetic polypeptide
MVKIISRKSLGTQNVYDIGVGEPHNFLLKNGLVASNCRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 185 - protein, 958 aa, Artificial Sequence
  Description of Artificial Sequence: Synthetic polypeptide
MVKIISRKSLGTQNVYDIGVGEPHNFLLKNGLVASNCEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 186 - protein, 955 aa, Artificial Sequence
  Description of Artificial Sequence: Synthetic polypeptide
MVKIISRKSLGTQNVYDIGVGEPHNFLLKNGLVASNCITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 187 - protein, 953 aa, Artificial Sequence
  Description of Artificial Sequence: Synthetic polypeptide
MVKIISRKSLGTQNVYDIGVGEPHNFLLKNGLVASNCPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 188 - protein, 853 aa, Artificial Sequence
  Description of Artificial Sequence: Synthetic polypeptide
MVKIISRKSLGTQNVYDIGVGEPHNFLLKNGLVASNCFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 189 - protein, 850 aa, Artificial Sequence
  Description of Artificial Sequence: Synthetic polypeptide
MVKIISRKSLGTQNVYDIGVGEPHNFLLKNGLVASNCVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 190 - protein, 838 aa, Artificial Sequence
  Description of Artificial Sequence: Synthetic polypeptide
MVKIISRKSLGTQNVYDIGVGEPHNFLLKNGLVASNCSLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 191 - protein, 837 aa, Artificial Sequence
  Description of Artificial Sequence: Synthetic polypeptide
MVKIISRKSLGTQNVYDIGVGEPHNFLLKNGLVASNCLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

What is claimed is:

1. A composition comprising:
A)
  (a) a first polynucleotide encoding a fusion protein comprising a deaminase and an N-terminal fragment of Cas9,
    wherein the N-terminal fragment of Cas9 starts at the N-terminus of Cas9 and is a contiguous sequence that terminates at position 302, 309, 312, or 354 of Cas9 as numbered in SEQ ID NO: 16, and
    wherein the N-terminal fragment of Cas9 is fused at the C-terminus to a split intein-N, and
  (b) a second polynucleotide encoding a C-terminal fragment of Cas9,
    wherein the C-terminal fragment of Cas9 starts:
      i) at position S303 when the N-terminal fragment terminates at position 302 of Cas9,
      ii) at position T310 when the N-terminal fragment terminates at position 309 of Cas9,
      iii) at position T313 when the N-terminal fragment terminates at position 312 of Cas9, or
      iv) at position S355 when the N-terminal fragment terminates at position 354 of Cas9,
    wherein the positions of Cas9 are as numbered in SEQ ID NO: 16, and
    wherein the C-terminal fragment of Cas9 is a contiguous sequence that terminates at the C-terminus of Cas9, and
    wherein the C-terminal fragment of Cas9 is fused at the N-terminus to a split intein-C; or
B)
  (a) a first polynucleotide encoding an N-terminal fragment of Cas9,
    wherein the N-terminal fragment of Cas9 starts at the N-terminus of Cas9 and is a contiguous sequence that terminates at position 302, 309, 312, or 354 of Cas9 as numbered in SEQ ID NO: 16,
    wherein the N-terminal fragment of Cas9 is fused at the C-terminus to a split intein-N, and
  (b) a second polynucleotide encoding fusion protein comprising a C-terminal fragment of Cas9 and a deaminase,
    wherein the C-terminal fragment of Cas9 starts:
      i) at position S303 when the N-terminal fragment terminates at position 302 of Cas9,
      ii) at position T310 when the N-terminal fragment terminates at position 309 of Cas9, iii) at position T313 when the N-terminal fragment terminates at position 312 of Cas9, or iv) at position S355 when the N-terminal fragment terminates at position 354 of Cas9, wherein the positions of Cas9 are as numbered in SEQ ID NO: 16, and wherein the C-terminal fragment of Cas9 is a contiguous sequence that terminates at the C-terminus of Cas9, and wherein the C-terminal fragment of Cas9 is fused at the N-terminus to a split intein-C; or C)
(a) a first polynucleotide encoding a fusion protein comprising a deaminase and an N-terminal fragment of Cas9, wherein the N-terminal fragment of Cas9 starts at the N-terminus of Cas9 and is a contiguous sequence that terminates at position 302, 309, 312, 354, 465, or 471 of Cas9 as numbered in SEQ ID NO: 16, wherein the N-terminal fragment of Cas9 is fused at the C-terminus to a split intein-N, and (b) a second polynucleotide encoding a C-terminal fragment of Cas9, wherein the C-terminal fragment of Cas9 starts:
i) at position S303 when the N-terminal fragment terminates at position 302 of Cas9, ii) at position T310 when the N-terminal fragment terminates at position 309 of Cas9, iii) at position T313 when the N-terminal fragment terminates at position 312 of Cas9, iv) at position S355 when the N-terminal fragment terminates at position 354 of Cas9, v) at position T466 when the N-terminal fragment terminates at position 465 of Cas9, or vi) at position T472 when the N-terminal fragment terminates at position 471 of Cas9, wherein the positions of Cas9 are as numbered in SEQ ID NO: 16, and wherein the C-terminal fragment of Cas9 is a contiguous sequence that terminates at the C-terminus of Cas9, wherein the N-terminus residue of the C-terminal fragment of Cas9 is a Cys substituted for an Ala, Ser, or Thr, and wherein the C-terminal fragment of Cas9 is fused at the N-terminus to a split intein-C.

2. The composition of claim 1, further comprising a single guide RNA (sgRNA) or a polynucleotide encoding the sgRNA.

3. The composition of claim 1, wherein the first and the second polynucleotides are joined or are expressed separately.

4. The composition of claim 1, wherein the deaminase is an adenosine deaminase.

5. The composition of claim 1, where the deaminase is a wild-type TadA or TadA7.10.

6. The composition of claim 1, wherein the deaminase is a TadA dimer.

7. The composition of claim 6, wherein the TadA dimer comprises a wild-type TadA and a TadA 7.10.

8. The composition of claim 1, wherein the fusion protein comprises a nucleus localization signal (NLS).

9. The composition of claim 8, wherein the NLS is a bipartite NLS.

10. The composition of claim 1, wherein the Cas9 has nickase activity or is catalytically inactive.

11. A composition comprising the fusion protein and the N- or C-terminal fragment of Cas9 of claim 1.

12. A vector comprising the first and the second polynucleotide of claim 1.

13. A cell comprising the composition of claim 1.

14. A method for delivering a base editor system to a cell, the method comprising contacting the cell with the first and second polynucleotides of claim 1; and a single guide RNA (sgRNA) or a polynucleotide encoding the sgRNA.

15. The method of claim 14, wherein the target polynucleotide is present in the genome of an organism.

16. The method of claim 15, wherein the organism is an animal, plant, or bacteria.

17. A polynucleotide encoding a fusion protein, wherein the fusion protein comprises a deaminase and an N-terminal fragment of Cas9, wherein the N-terminal fragment of Cas9 starts at the N-terminus of Cas9 and is a contiguous sequence that terminates at position 302, 309, 312, or 354 of Cas9 as numbered in SEQ ID NO: 16, and wherein the N-terminal fragment of Cas9 is fused at the C-terminus to a split intein-N.

18. A polynucleotide encoding a fragment of an A-to-G Base Editor fusion protein, the fusion protein comprising one or more deaminases and an N-terminal fragment of Cas9 of claim 1, wherein the N-terminal fragment is fused at the C-terminus to a split intein-N.

19. A polynucleotide encoding a fragment of an A-to-G Base Editor fusion protein, the fusion protein comprising one or more deaminases and a C-terminal fragment of Cas9 of claim 1, wherein the C-terminal fragment is fused at the N-terminus to a split intein-C.

* * * * *